United States Patent 12,569,549 (FLAVIVIRUS VACCINE) - sequence listing, part 7

SEQ ID NO: 5233 - protein, 3288 aa, synthetic construct
  REGION 1..3288: note = derived and/or modified protein sequence (wt) from DENV-4__KM190936__SS-prME
STITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5234 - protein, 3288 aa, synthetic construct
  REGION 1..3288: note = derived and/or modified protein sequence (wt) from DENV-4__JQ915090__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELAKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFMRSTTPLVMAWRTIMAVFFVITLIPLCRTSCLQKQSHWVEMTALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRSDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENMSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSAIEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSSPSESEGVL

SEQ ID NO: 5235 - protein, 3288 aa, synthetic construct
  REGION 1..3288: note = derived and/or modified protein sequence (wt) from DENV-4__KJ160504__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFGTEYPKTKLTDWDFVVTTDISEMGANFRAGRVIDPRRCLKPVILTDGPERVILAGPIPVTPASAAQRRGRVGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPAYLSSRAKLALDNIVMLHTTERGGRAYQHALNELPESLETLMLVALLGAMTAGIFLFFMQGKGIGKLSMGLITIAVASGLLWIAEIQPQWIAASIILEFFLMVLLIPEPEKQRTPQDNQLIYVILTVLTIIGLIAANEMGLIEKTKTDFGFYQVKTETTILDVDLRPASAWTLYAVATTVLTPMLRHTIENTSANLSLAAIANQAAVLMGLGKGWPLHRMDLGVPLLAMGCYSQVNPTTLTASLVMLFVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5236 - protein, 3288 aa, synthetic construct
  REGION 1..3288: note = derived and/or modified protein sequence (wt) from DENV-4__GU289913__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5237 - protein, 3288 aa, synthetic construct
  REGION 1..3288: note = derived and/or modified protein sequence (wt) from DENV-4__KJ579243__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGCLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASGLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5238 - protein, 3288 aa, synthetic construct
  REGION 1..3288: note = derived and/or modified protein sequence (wt) from DENV-4__KJ579246__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPIHSWEDIPYLGKREDLWCGSLIGLSSRATWAKNIHTAITQVRNLIGKEEYVDYMPVMKRYSAPSESEGVL

SEQ ID NO: 5239 - protein, 3288 aa, synthetic construct
  REGION 1..3288: note = derived and/or modified protein sequence (wt) from DENV-4__KJ579248__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRVGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5240 - protein, 3288 aa, synthetic construct
  REGION 1..3288: note = derived and/or modified protein sequence (wt) from DENV-4__KJ579240__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAVTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5241 - protein, 3288 aa, synthetic construct
  REGION 1..3288: note = derived and/or modified protein sequence (wt) from DENV-4__KJ596658__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5242 - protein, 3288 aa, synthetic construct
  REGION 1..3288: note = derived and/or modified protein sequence (wt) from DENV-4__KJ596659__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5243 - protein, 3288 aa, synthetic construct
  REGION 1..3288: note = derived and/or modified protein sequence (wt) from DENV-4__KJ596661__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHIEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPTLTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKARKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5244 - protein, 3288 aa, synthetic construct
  REGION 1..3288: note = derived and/or modified protein sequence (wt) from DENV-4__KJ596663__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKTLAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5245 - protein, 3288 aa, synthetic construct
  REGION 1..3288: note = derived and/or modified protein sequence (wt) from DENV-4__KJ596664__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWNLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5246 - protein, 3288 aa, synthetic construct
  REGION 1..3288: note = derived and/or modified protein sequence (wt) from DENV-4__KJ596665__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASGLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTENMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5247 - protein, 3288 aa, synthetic construct
  REGION 1..3288: note = derived and/or modified protein sequence (wt) from DENV-4__KJ596668__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLREYGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5248 - protein, 3288 aa, synthetic construct
  REGION 1..3288: note = derived and/or modified protein sequence (wt) from DENV-4__KJ596670__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIVLGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQIGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5249 - protein, 3288 aa, synthetic construct
  REGION 1..3288: note = derived and/or modified protein sequence (wt) from DENV-4__KJ596671__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5250 - protein, 3288 aa, synthetic construct
  REGION 1..3288: note = derived and/or modified protein sequence (wt) from DENV-4__KJ579241__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKIPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTMRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5251 - protein, 3288 aa, synthetic construct
  REGION 1..3288: note = derived and/or modified protein sequence (wt) from DENV-4__KJ596672__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSIAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5252 - protein, 3288 aa, synthetic construct
  REGION 1..3288: note = derived and/or modified protein sequence (wt) from DENV-4__KJ579242__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLVFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTMRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5253 - protein, 3288 aa, synthetic construct
  REGION 1..3288: note = derived and/or modified protein sequence (wt) from DENV-4__GQ398256__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVAVTVHNGDTHAVGNDTSSHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTIPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGASGNIVSSVNTISKMLLNRFTTRHRKPTYEKDVDLGAGTRSVSTETEKPDMTVIGRRLQRLQEEHKETWHYDQENPYRTWAYHGSYEAPSTGSASSMVNGIVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVNKERALHQEGKCESCVYNMMGKREKKLGEFGRAKGSRAIWYMWLGARFLEFEALGFLNEDHWFSRENSWSGVEGEGLHRLGYILEDIDKQDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSASLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5254 - protein, 3288 aa, synthetic construct
  REGION 1..3288: note = derived and/or modified protein sequence (wt) from DENV-4__KC333651__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTIPLVMAWRTIMAVFFVVTLIPLCRTSCLQKHSHWVEITALILGAQALPVYLMTLMKGASRRSWPLNEGIMAVGLVSLLGSALLKNDVPLAGPMVAGGLLLAAYVMSGSSADLLLEKAANVQWDEMADITGSSPIIEVKQDEDGSFSIRDVEETNMMTLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCAGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGASGNIVSSVNTISKMLLNRFTTRHRKPTYEKDVDLGAGTRSVSTETEKPDMTVIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKQEGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEDYVDYMPVMKRYSAPSESEGVL

SEQ ID NO: 5255 - protein, 3288 aa, synthetic construct
  REGION 1..3288: note = derived and/or modified protein sequence (wt) from DENV-4__JN559740__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTRAVGNDISNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLKPASAWTLYAVATTILTPMLRHTIENTSANLSLAAIANQAAVLMGLGKGWPLHRMDLGVPLLAMGCYSQVNPITLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5256 - protein, 3288 aa, synthetic construct
  REGION 1..3288: note = derived and/or modified protein sequence (wt) from DENV-4__JN559741__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5257 - protein, 3288 aa, synthetic construct
  REGION 1..3288: note = derived and/or modified protein sequence (wt) from DENV-4__JQ513334__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAMEVALLRTYCIEASISNITTATRCPTQGEPYLKEEQDQQYICRRDVVDRGWGNGCGLFGKGGVVTCAKFSCSEKITGNLVQIENLEYTVVVTVHNGDTHAVGNDTSNHGVTATITPRSPSVEVELPDYGELTLDCEPRSGIDFNEMILMKMKKKTWLVHKQWFLDLPLPWAAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSIPLAENTNSVTNIELEPPFGDSYIVIGVGNSALTLHWFRKGSSIGKMFESTYRGAKRVAILGETAWDFGSVGGLFTSLGKAVHQVFGSVYTTMFGGVSWMVRILIGLLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5258 - protein, 3288 aa, synthetic construct
  REGION 1..3288: note = derived and/or modified protein sequence (wt) from DENV-4__JQ513336__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSEKITGNLVQIENLEYTVVVTVHNGDTHAVGNDTSNHGVTATITPRSPSVEVELPDYGELTLDCEPRSGIDFNEMILMKMKKKTWLVHKQWFLDLPLPWAAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMVRILIGLLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5259 - protein, 3288 aa, synthetic construct
  REGION 1..3288: note = derived and/or modified protein sequence (wt) from DENV-4__JQ513338__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQEQQYICRRDVVDRGWGNGCGLFGKGGVVTCAKFSCSGKITGNLVQIENLEYTVVVTVHNGNTPAVGNDTSNHGVTAPITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDENHMFAGHLKCKVRMGKLRIKGMSYTMCSGKFSIDKEMAETQHGTTVVKVKYEGAGAPCKVPIEIRDVNKEKVVGRVISATPLAENTNSVTNIELEPPFGDRYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5260 - protein, 3288 aa, synthetic construct
  REGION 1..3288: note = derived and/or modified protein sequence (wt) from DENV-4__JQ513339__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMATFKVPHAKRQDVTLLGSQEGAMHSALAGATEVDSGDENHMFAGHLKCKVRMGKLRIKGMSYTMCSGKFSIDKEMAETQHGTTVVKVKYEGAGAPCKVPIEIRDVNKEKVVGRVLSATPLAENTNSVTNIELEPPFGDSYIVIGVGNSALTLHWFTKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5261 - protein, 3288 aa, synthetic construct
  REGION 1..3288: note = derived and/or modified protein sequence (wt) from DENV-4__JQ513343__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMETFKVPHAKRQDVTLLGSQEGAMHSALAGATEVDSGDENHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5262 - protein, 3288 aa, synthetic construct
  REGION 1..3288: note = derived and/or modified protein sequence (wt) from DENV-4__KT276273__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGRPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVELPDYGELTLDCEPRSGIDFNEMILMKMNKKTWLVHKQWFLDLPLPWTAGADTSEVHWNNKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVIGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVIDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSLEVEDYGFGMFTTNIWMKFREGSSEMCDHRLMSAAIKDQKAVHADMGYWIESSKNQTWQIEKASLIEVKTCLWPKTHTLWSNGVLESQMLIPKSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVLSIPYDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRANAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLKETACLAKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYMDYMPVMRRYSAPSESEGVL

SEQ ID NO: 5263 - protein, 3288 aa, synthetic construct
  REGION 1..3288: note = derived and/or modified protein sequence (wt) from DENV-4__KU523872__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAHMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGNGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWVDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPVIEVKQDEDGSFSIRDVEETNMITLLVKLALITVSGLYPLAIPVTMAIWYIWQVKTQRSGALWDVPSPAATQKATLSEGVYRIMQRGLFGKTQVGVGIHMEGVFHTMWHVTRGSVICHETGRLEPSWADVRNDMISYGGGWKLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLVAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKTKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGKTLRVLKMVEPWLSSKPEFCIKVLNPYMPTVIEELEKLQRRHGGSLVRCPLSRNSTHEMYWVSGASGNIVSSVNTISKMLLNRFTTRYRKPTYEKDVDLGAGTRSVSTETEKPDMTIIGRRLQRLREEHKETWHYDQENPYRTWAYHGSYEAPSTGSASSMVNGVVKLLTKPWDVVPMVTQLAMTDTTPFGQQRVFKEKVDTRTPQPKPGTRKIMTTTANWLWALLGKKKSPRLCTREEFISKVRSNAAIGAVFQEEQGWTSASEAVNDSRFWELVDKERALHQEGRCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPEGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5264 - protein, 3288 aa, synthetic construct
  REGION 1..3288: note = derived and/or modified protein sequence (wt) from DENV-4__KP140942__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGRPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVELPDYGELTLDCEPRSGIDFNEMILMKMNKKTWLVHKQWFLDLPLPWTAGADTSEVHWNNKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVIGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVIDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSLEVEDYGFGMFTTNIWMKFREGSSEMCDHRLMSAAIKDQKAVHADMGYWIESSKNQTWQIEKASLIEVKTCLWPKTHTLWSNGVLESQMLIPKSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRMGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSLTLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRANAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLKETACLAKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYMDYMPVMRRYSAPSESEGVL

SEQ ID NO: 5265 - protein, 3288 aa, synthetic construct
  REGION 1..3288: note = derived and/or modified protein sequence (wt) from DENV-4__KU523871__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTRGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQATAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMMTLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIIMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCAGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVVPMVTQLAMTDTTPFGQQRVFKEKVDTRTPQPKPGTRMIMTTTANWLWTLLGKKKSPRLCTREEFISKVRSNAAIGAVFQEEQGWTSASEAVNDSRFWELVDKERALHQEGKCESCVYNMMGKREKKLGEFGRAKGSRAMWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVYSWEDIPYLGKREDLWCGSLIGLSSRATWAKNIHTAITQVRNLIGKEDYVDYMPIMKRYSAPSESEGVL

SEQ ID NO: 5266 - protein, 3288 aa, synthetic construct
  REGION 1..3288: note = derived and/or modified protein sequence (wt) from DENV-4__HQ332175__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSVDLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAIAQVRNLIGKEEYVDYMPVMKRYSAPSESEGVL

SEQ ID NO: 5267 - protein, 3288 aa, synthetic construct
  REGION 1..3288: note = derived and/or modified protein sequence (wt) from DENV-4__HQ332172__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPTATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAILMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLALCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5268 - protein, 3288 aa, synthetic construct
  REGION 1..3288: note = derived and/or modified protein sequence (wt) from DENV-4__HQ332176__SS-prME
STITLLCLIPTVMAFHLSTRDGEPLMIVARHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPSYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5269 - protein, 3288 aa, synthetic construct
  REGION 1..3288: note = derived and/or modified protein sequence (wt) from DENV-4__HQ332174__SS-prME
STITLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTMGPWHLGKLEIDFGECPGTTVTIQENCDHRGPSLRTTTASGKLVTQWCCRSCTMPPLRFLGEDGCWYGMEIRPLSEKEENMVKSQVTAGQGASETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQAKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRTVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5270 - protein, 3288 aa, synthetic construct
  REGION 1..3288: note = derived and/or modified protein sequence (wt) from DENV-4__KT026308__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVQLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGHGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAVFMTATPPGTTDPFPQSNSPIEDIEREIPERSWNTGFDWITDYQGKTVWFVPSIKAGNDIANCLRKSGKKVIQLSRKTFDTEYPKTKLTDWDFVITTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSHKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWAFCEVLTLATGPILTLWEGNPGRFWNTTIAVSTANIFRGSYLAGAGLAFSLIKNAQTPRRGTGTMGETLGEKWKRQLNSLDRKEFEEYKRSGILEVDRTEARSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTQVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMTPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5271 - protein, 3288 aa, synthetic construct
  REGION 1..3288: note = derived and/or modified protein sequence (wt) from DENV-4__KT026309__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVQLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGHGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAVFMTATPPGTTDPFPQSNSPIEDIEREIPERSWNTGFDWITDYQGKTVWFVPSIKAGNDIANCLRKSGKKVIQLSRKTFDTEYPKTKLTDWDFVITTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSHKVASAGISYKDREWCFTGERNNQILEENIEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWAFCEVLTLATGPILTLWEGNPGRFWNTTIAVSTANIFRGSYLAGAGLAFSLIKNAQTPRRGTGTMGETLGEKWKRQLNSLDRKEFEEYKRSGILEVDRTEARSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTQVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMTPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5272 - protein, 3288 aa, synthetic construct
  REGION 1..3288: note = derived and/or modified protein sequence (wt) from DENV-4__KF907503__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTSTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLIMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATSTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIIIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5273 - protein, 3288 aa, synthetic construct
  REGION 1..3288: note = derived and/or modified protein sequence (wt) from DENV-4__AY947539__SS-prME
STMTLLCLIPTAMAFHLSTRDGEPLMIVARHERGRPLLFKTTEGINKCTLIAMDLGEMCEDTVTYECPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDIPNHGVTATITPRSPSVEVKLPDYGELTLDCEPRSGIDFNEMILMKMKKKTWLVHKQWFLDLPLPWAAGADTSEVHWNYKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAEYTNSVTNIELEPPFGDSYIVIGVGDSALTLHWFRKGSSIGKMLESTYRGAKRMAILGETAWDFGSVGGLLTSLGKAVHQVFGSVYTTMFGGVSWMVRILIGFLVLWIGTNSRNTSMAMTCIAVGGITLFLGFTVHADTGCAVSWSGKELKCGSGIFVIDNVHTWTEQYKFQPESPARLASAILNAHEDGVCGIRSTTRLENIMWKQITNELNYVLWEGGHDLTVVAGDVKGVLSKGKRALAPPVNDLKYSWKTWGKAKIFTPEAKNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALSLTFIRSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDIEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERTGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVISTDGPERVILAGPIPVTPASAAQRRGRIGRNPAQEDDQYVFSGDPLKNDEDHAHWTEAKMLLDNIYTPEGIIPTLFGPEREKNQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLIASLVMLLVHYAIIGPGLQAKATREAQKRTAAGIMKNPTVDGITVIDLEPISYDPKFEKQLGQVMLLVLCAGQLLLMRTTWAFCEVLTLATGPVLTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITQDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPFESEGVL

SEQ ID NO: 5274 - RNA, 9879 nt, synthetic construct
  misc_feature 1..9879: note = derived and/or modified CDS sequence (wt) from DENV-1__AB608789__SS-prME
  source 1..9879: mol_type = other RNA
tctgtgaccatgctccttatgctgatgcccacagccttggcgttccatctgactacacgagggggagagccgcacatgatagtcaccaagcaggaaagaggaaagtcacttttgtttaagacctcagcaggtgtcaacatgtgcacccttatagcgatggatttgggagagttatgtgaggacacaatgacttacaaatgccctcgaattactgaggcggaaccagatgacattgattgttggtgcaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggatcattttcattttgttaatgctggtaacaccatccatggccatgcgatgcgtgggaataggcagcagggacttcgtggaaggactgtcaggagcaacttgggtagacgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactggtggaagaacaagacgcgaactttgtgtgtcgacgaacgtttgtggacagaggctggggcaatggctgtggtctcttcggaaaaggaagcctaataacgtgtgctaagttcaagtgtgtgacaaaactggaaggaaagatagttcaatatgaaaacttgaaatattcagtaatagtcaccgtccacactggagaccaacaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagagaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccctatagtcactgacaaagaaaaaccagtcaacattgaggcagaaccgccttttggtgagagttacattgtgataggagcaggtgaaaaagctttgaaactaagctggttcaagagaggaagcagcatagggaaaatgtttgaggcaactgccagaggagcacgaaggatggccatactgggagacaccgcatgggactttggttctataggaggagtgttcacatctgttggaaaactagtacaccagatttttggaactgcatatggagttttgttcagcggtgtttcctggaccatgaaaataggaataggggttctgttgacatggctaggattaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaacgaactgaaccacatcttacttgaaaatgacatgaaattcacagtggttgtaggagatgttgttgggatcttggctcaagggaaaaaaatgattaggccacaacccatggaatacaaatactcctggaaaagctggggaaaagctaaaatcataggggcagatgtacagaacaccaccttcatcattgacggcccaaacaccccagaatgccctgatgatcaaagagcatggaacatttgggaagttgaggactatggatttggaattttcacgacaaacatatggttgaaattgcgtgactcttacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcggggaccatctcttagaaccacaacagtcacaggaaagataattcatgaatggtgttgcagatcttgtacgctaccacccttacgtttcaaaggagaagatgggtgttggtacggtatggaaatcagaccagtcaaggaaaaggaagagaatctagtcaaatcaatggtctctgcagggtcaggggaagtggacagcttttcactaggactgctatgcatgtcaataatgatcgaagaggtgatgagatccagatggagtagaaaaatgctgatgactggaacactggctgtgttcctccttctcataatgggacaattgacatggaatgatctgatcaggttatgcatcatggttggagccaacgcttccgacaggatggggatgggaacgacgtacctagctctgatggccacttttaaaatgagaccaatgtttgctgtcgggctattattccgcagactaacatccagagaagttcttcttcttacaattggattgagtctagtggcatctgtggagttaccaaattccttggaggagctgggggatggacttgcaatgggcattatgattctaaaattattgactgactttcagtcacatcagctgtgggctaccttgctgtccttgacattcatcaaaacaacggtttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacttgtcattagagaaagcggctgaggtctcctgggaagaagaagcagaacactctggtgcctcacacaatatattagtggaggtccaagatgacggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacccagccctccagaagtggaaagagcagttcttgatgaaggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaacggaagctgcgcacactaattttggctcccacaagggttgtcgcttccgaaatggcagaggcgcttaaaggaatgccaataaggtaccaaacaacagcagtgaagagtgaacacacaggaaaagagatagttgatctcatgtgtcacgccactttcaccatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacctttgatacagagtaccaaaaaacaaaaaataacgactgggattatgtcgtcacaacagacatctccgaaatgggagcaaacttccgagccgacagggtgatagacccaagacggtgtctgaaaccggtaatactaaaagatggtccagagcgtgttattctagcaggaccgatgccagtgactgtggccagtgctgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagattgcggggtgaagcaaggaagacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaggagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcttatagacatgcaatggaagaactgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggattattggaaaccacaaagaaagacttagggattggccatgtggctgttgaaaatcaccaccatgccacaatgttggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctactcacaggtgaatccattgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactagggcaaataatgttgttgatactatgtacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggtacgggagcccaaggggaaacattgggagagaaatggaaaagacagctgaaccaactgagcaagtcagaattcaacacttacaaaagaagtgggattatggaagtggacagatccgaagccaaagagggagtgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaactatagaagaaggaagaacgttacgcgtcctaaagatggtggaaccatggctcagaggaaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagctatgactgacactacaccctttggacaacagagggtgtttaaagagaaagttgacacgcgcacaccaaaagcaaaacgaggcacagcacaaatcatggaggtgacagccaggtggttatggggttttctttctagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagagagcttcacaaacagggaaaatgtgccacgtgtgtttacaacatgatggggaagagagagaaaaaactaggagagttcggaaaggcgccagaaagtcgtgcaatatggtacatgtggttgggagcacgctttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggacacaagaataacagaggatgaccttcagaatgaggccaaaattactgacatcatggagcccgaacatgccctactggctacgtcaatcttcaagctgacctatcaaaataaggtggtaagggtacagagaccagcaaaaaatggaaccgtgatggatgtcatatccagacgtgaccagagaggaagtggccaggtcggaacttatggcttaaacactttcaccaacatggaagctcagctaataagacaaatggagtctgagggaatcttttcatccagcgaattggagaccccaaatttagccgagagagttctcgactggctgggaaaatatggcgtcgaaaggctgaaaagaatggcaatcagcggagatgactgcgtggtgaaaccaattgatgacaggttcgcaacagccttaacagctctgaatgatgtgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgttgtcagtgtggaatagggtttggatagaggaaaacccatggatggaggacaaaacccatgtgtccagttggggagatgttccatatttaggaaaaagggaagatcagtggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5275 - RNA, 9879 nt, synthetic construct
  misc_feature 1..9879: note = derived and/or modified CDS sequence (wt) from DENV-1__AB608788__SS-prME
  source 1..9879: mol_type = other RNA
tccgtgaccatgctccttatgctgctgcccacagtcttggcgtttcatctgaccacacgagggggagagccgcatatgatagttaccaagcaggaaagaggaaagtcacttttgtttaagacctcagctggtgtcaacatgtgcacccttattgcgatggatttgggagagttatgtgaggacacaatgacttacaaatgtcctcgaatcactgaggcggaaccagatgacgttgattgttggtgcaatgccacagacacatgggtgacctatggaacgtgttcccaaactggcgagcatcgacgagacaaacgttccgtcgcactggctccacacgtgggacttggtctagaaacaagaaccgaaacgtggatgtcctctgaaggcgcttggaaacaaatacaaagagtggagacttgggccctgagacacccaggattcacagtgatagccctttttctagcacatgccataggaacatccatcacccagaaagggattattttcattttgttgatgctggtaacaccatccatggccatgcgatgtgtgggaataggcaacagggactttgtggaaggactgtcgggagcaacgtgggtagatgtggtactggaacatggaagctgtgtcaccaccatggcaaaagataaaccaacattggacattgaactcttgaagacggaagtcacaaaccctgccgtcctgcgcaaactgtgcattgaagctaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcgggaaaggtagcctaataacgtgtgctaagttcaagtgtgtgacaaaactggaaggaaagatagttcaatatgaaaacttgaaatactcagtaatagtcaccgtccacactggagaccagcaccaggtgggaaatgaaagcacagaacatgggacaacagcaactataacacctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaactgcccgaggagcacgaaggatggccatactgggagacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctggtaacactgtacctaggagtcatggttcaggcggattcgggatatgtaatcaactggaaaggcagagaactcaaatgtggaagtggcatttttgtcaccaatgaagttcacacttggacagagcaatacaaatttcaggctgactccccaaaaagactatcagcagccatcgggaaggcatgggaggagggtgtgtgtggaattcgatcagccactcgtctcgagaacatcatgtggaagcaaatatcaaatgaactgaaccacatcttacttgaaaatgacatgaaattcacagtggtcgtaggagatgttagtgggatcttggcccaagggaaaaaaatgattaggccacaacccatggaacacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctccttcatagaagttaaaacatgcgtttggccaaaatcccacactctatggagcaatggagttctggaaagtgaaatgataattccaaagatatatggaggaccaatatctcagcacaactacagaccaggatatttcacacaaacatcagggccgtggcacttaggcaagttggaactagattttgatttgtgtgagggtaccacagttgttgtggatgaacattgtggaaatcgaggaccatctcttagaaccacaacagtcacaggaaaaataatccatgaatggtgctgcagatcttgtacgctaccacccttacgttttaaaggagaagatgggtgttggtatggtatggaaattagaccagtcaaggaaaaggaagagaatctagttaaatcaatggtctctgcagggtcaggagaagtggacagcttttcactaggactgctatgcatatcaataatgattgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctattgttccgcagactaacatctagagaagttcttcttcttacaattggattgagtctagtggcatccgtggagctaccaaattccttggaggagctgggggatggacttgcaatgggcattatgatcttaaaattactgactgattttcagtcacatcagctgtgggctgccttgctgtccctgacatttatcaaaacaactttttctttgcactatgcatggaagacaatggctatggtactgtcaattgtgtctctcttccccttatgcctgtccacgacctctcaaaaaacaacatggcttccggtgctattgggatctcttggatgcaaaccactaaccatgtttctcatagcagaaaacaaaatctggggaaggaaaagttggcctctcaatgaaggaatcatggctgttggaatagtcagcatcttactaagttcactcctcaagaatgatgtgccgctagctgggccactaatagctggaggcatgctaatagcatgttatgttatatctggaagctcagctgatttatcactagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactctgctggcagtttcaggggtgtacccattatcaataccagcgaccctttttgtgtggtatttttggcagaaaaagaaacagagatcaggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaacacgggagaagaagtgcaggtgattgctgttgaaccagggaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcaggaaaaacaagaagatatcttccagccatagtccgtgaggccataaaaaggaagctgcgcacactaattttggctcccacaagagttgtcgcttccgaaatggcagaggcgctcaagggaatgccgataaggtatcagacaacagcagtgaagagtgaacacacaggaaaggagatagttgacctcatgtgccacgccactttcactatgcgtcttctgtctcctgtgagagttcccaattacaacatgattatcatggatgaagcacatttcaccgatccatccagcatagcggccagagggtacatctcaacccgagtgggtatgggtgaagcagctgcgatctttatgacagccactcccccaggatcagtggaggcctttccacagagcaatgcagttatccaagatgaggaaagagacattcctgagagatcatggaactcaggctatgactggatcactgacttcccaggtaaaacagtctggtttgttccaagcatcaaatcaggaaatgacattgccaactgtttaagaaagaatgggaaacgggtgattcaattgagcagaaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgctgcccagaggagaggaagaatcggaaggaaccaaaataaggaaggtgatcagtacatctacatgggacagcctttaaacaacgatgaagaccacgctcattggacagaagcaaaaatgctccttgacaatataaacacaccagaagggattatcccagccctctttgaaccggagagagaaaagagtgcggcaatagacggggaatatagactgcggggtgaggcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggcttgatgccagaacatactcagacccattggccctgcgcgagtttaaagagtttgcagcaggaagaagaagcgtctcaggtgatctaatattagaaatagggaaacttccacagcacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactttgcgtgatggcttcaagcgtgctgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgctggacgtagacttacatccagcttcagcctggaccctctatgcagtggccacaacaattatcacccccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctactcccaggtgaatccactgacgctgacagcggcagtattgatgttagtggctcattacgccataattggacctggactgcaagcaaaagctactagagaagcccaaaaaaggacagcggccggaataatgaagaatccaactgtcgatggaatagttgcaatagatttggaccctgtggtttatgatgcaaaatttgaaaaacaactaggccaaataatgttgttgatactatgcacatcacagatcctcttgatgcggactacatgggccttgtgtgaatccatcacactggctactggacctctgaccacgctttgggagggatctccaggaaaattttggaacaccacgatagccgtgtccatggcaaacatattcaggggaagttatctagcaggagcaggcctggccttctcactaatgaaatctctaggaggaggtaggagaggtacgggagcccaaggggaaacattgggagaaaaatggaaaagacagctaaaccaactgagcaagtcagaattcaacacttacaaaaggagtgggattatagaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgccgggctgaagaaagtcacagaagtgaagggatacacaaaaggaggagctggacatgaggaaccaatcccaatggcgacctatggatggaacctagtaaagctatactccgggaaagacgtattctttacaccacctgaaaaatgtgacacccttttgtgtgacattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcaaatgcaaagaaaacatggaggaatgctagtgcgaaacccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcgaaacaaggcacagcacaagtcatggaggtgacagctaggtggttatggggttttctttctagaaacaaaaaaccaagaatctgcacaagagaggagttcacaagaaaagttaggtcaaacgcagccattggagcagtgttcgttgatgaaaatcaatggaactctgcaaaagaagcagtggaagatgagcggttttgggaccttgtgcacagagagagggagcttcacaaacagggaaaatgtgccacatgtgtttacaatatgatggggaaaagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccacagactcggatatatactcagagacatatcaaagattccagggggaaatatgtatgcagatgacacagccggatgggatacaaggataacagaggatgatcttcagaatgaagccaaaatcactgacatcatggagcccgaacatgccctactggctacgtcaatcttcaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggaatcttttcacccagcgaattagagaccccaaatttggccgagagagttctcgactggttggaaaaatatggcgtcgaaaggctgaaaagaatggcaatcagcggagatgactgcgtggtgaagccaattgatgacaggttcgcaacagccctaacagctctgaacgatatgggaaaagtaaggaaagacataccacaatgggaaccttcaaaaggatggaatgactggcaacaagtgcctttttgttcacaccatttccaccagctgattatgaaggatgggagggaaatagtggtgccatgccgcaaccaagatgaacttgtgggtagggctagagtgtcacaaggtgccggatggagcctgagagaaactgcatgcctgggcaagtcatatgcacaaatgtggcagctgatgtacttccacaggagagacctgagactagctgctaatgccatctgttcagccgttccagttgattgggtcccaaccagccgcaccacttggtcgatccatgcccatcatcaatggatgacaacagaaaacatgttgtcagtgtggaatagggtttggatagaggaaaacccatggatggaggacaaaacccatgtgtccagttgggaagatgttccatatttagggaaaagggaagatcagtggtgtggttccctgataggcttaacagcaagggccacctgggccactaacatacaagtggccataaaccaagtgagaaggctaattgggaatgagaattatctagattatatgacatcaatgaagagattcaagaacgatagcgatcccgaaggggcactctggtga

SEQ ID NO: 5276 - RNA, 9879 nt, synthetic construct
  misc_feature 1..9879: note = derived and/or modified CDS sequence (wt) from DENV-1__AB608786__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagctatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccttggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacagaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgcgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcgtccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagcccaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagacggtccagagcgtgttattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagcgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtagagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaggaagtgggattatggaagtggacagatccgaagccaaagagggattgaaaagaggagaaacaaccaaacatgcagtgtcgagaggaaccgctaaactgaggtggtttgtggaaaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagacatcattggccagaggatagagaacataaaacatgaacataagtcaacatggcattatgatgaggacaatccatataaaacgtgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtaa

SEQ ID NO: 5277 - RNA, 9879 nt, synthetic construct
  misc_feature 1..9879: note = derived and/or modified CDS sequence (wt) from DENV-1__AB608787__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccttgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgttcacactggagaccagcatcaggtgggaaatgaaagcacagaacatgggacaactgcaactataacacctcaagctcctacgacggaaatacagctgaccgactacggagctcttacattggattgttcacctagaacaggattagattttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagctcgaaggatggccatactgggagacaccgcatgggactttggttctataggaggagtgttcacgtctgtaggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcagattcaggatgcgtaataaattggaaaggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatttggccaaaatcccatactctatggagcaatggagttctggaaagtgagatgataattccaaagatctatggaggaccaatatctcagcataactacagaccaggatatttcacacaaacggcagggccgtggcacctaggcaagttggaactggatttcgatttgtgtgagggtaccacggtcgttgtggatgaacattgtggaaatcgaggaccatctcttaggaccacaacagtcacaggaaagatagttcatgaatggtgttgcagatcttgcacgctaccacccttacgtttcagaggagaagatgggtgctggtacggtatggaaatcagaccagtcaaggaaaaggaagagaatctagtcaaatcaatggtctctgcagggtcaggagaagtggacagcttctcactaggattgctatgcatatcaataataatcgaagaggtgatgagatccagatggattagaaaaatgctgatgactggaacactgggtgtgttcttccttctcattatgggtcaattgacatggaatgatctgatcagattatgcatcatggttggagccaacgcttctgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggttcaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagcgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaagggaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagttatccaggatgaggaaagagacattcctgagagatcatggaactcaggctatgagtggatcactgacttcccaggtaaaacagtctggtttgttccaagcattaaagcaggaaatgacattgccaactgcttaagaaaaaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgcgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaattacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctattggcctactctgcgtgatggcttcaagcgtactgctatggatggccagtgtggagccccattggatagcggcctccatcatactggagttcttcctgatggtgttgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactaacgctgacagcagcggtgttgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacactttgggagggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaggaagtgggattatggaagtggacagatctgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaaccatagaggaaggaagaacgctacgcgttctaaagatggtggaaccatggctcaaaggaaaccaattttgcataaaaattctgaatccctacatgccaagtgtggtggaaactctggagcaaatgcaaagaaaacatggaggaatgctagtgcgaaatccactttcaagaaattccactcatgagatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaatataaaacatgaacataagtcgacatggcattatgatgaggacaatccatataaaacatgggcctatcatggatcatatgaggttaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggaacttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggacttcacaaacttggatatatactcagagacatatcaaagattccagggggaaacatgtatgcagatgacacagccggatgggatacgaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaatatggaagcccagctgataagacaaatggagtctgagggaatcttttcacccagcgaattagagaccccaaatttagccgagagagttctcgactggctggaaaaatatggcgtcgaaaggctgaaaagaatggctattagcggagatgactgcgtagtgaaaccaattgatgataggttcgcgacagccttaacagctctgaatgatatgggaaaagtaagaaaagatataccacaatgggaaccttcaaaaggatggaatgattggcaacaagtgcctttttgttcacaccacttccaccagctgattatgaaagatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagatctgagactggccgctaatgctatctgttcagccgttccagttgattgggttccaaccagccgcaccacctggtcgatccatgcccatcaccaatggatgacaacagaagacatgctgtcagtatggaatagggtttggatagaggaaaacccatggatggaggacaaaacccatatatccagttgggaagatgttccatatctaggaaaaagggaagatcaatggtgtggatcactgataggcttaacagcaaggcccacctgggccaccaacatacaagtggccataaaccaagtgagaagactaattgggaatgagaattatctagattacatgacatcaatgaagagattcaagaacgagagtgaacccgaaggggcactctggtga

SEQ ID NO: 5278 - RNA, 9879 nt, synthetic construct
  misc_feature 1..9879: note = derived and/or modified CDS sequence (wt) from DENV-1__HE795086__SS-prME
  source 1..9879: mol_type = other RNA
tctgtgaccatgctccttatgctgatgcccacagccttggcgttccatttgactacacgggggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgtcctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggctctgaggcacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacactaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctgaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattgtacctaggagttatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggagtacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccactttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatttggccaaagtcccatactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcataatgattttaaaattattgaccgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcactaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagatgggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaatgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcctatgatgaggcacacaatcgaaaacacaacggcaaacatttccctaacagccattgcaaaccaggcggctatattgatgggacttgacaaaggatggccaatatcgaagatggacataggagttccacttctcgccttggggtgctattcccaggtgaatccactgacgctgacagccgcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaatatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaatatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctggagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattaccgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggttggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagccctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacccacatatccagttgggaagatgttccatatttagggaaaagggaagatcaatggtgtggatctctgataggcttaacagcaagggccacctgggccaccaacatacaagtggccattaaccaagtgagaagactaattgggaatgagaattatctagattacatgacatcaatgaagagattcaagaacgagagtgatcctgaaggggcactctggtga

SEQ ID NO: 5279 - RNA, 9879 nt, synthetic construct
  misc_feature 1..9879: note = derived and/or modified CDS sequence (wt) from DENV-1__AB189120__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggattcacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgcatagaagctaaaatatcaaataccaccactgactcgagatgtccgacacaaggagaagccacgctggtggaagaacaagacgcgaactttgtgtgtcgacgaacattcgtggacagaggctggggcaatggttgtggactattcggaaaaggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaatagacaagacttgctggtcacatttaagacagctcatgcaaagaagcaggaagcagtcgtactaggatcacaagaaggagcaatgcacactgcgttgactggagcgacagaaatccaaacgtctggaacgacaacaatttttgcaggccacctgaaatgcagactaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggttctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggggtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaatatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatcccacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagttgttgtggatgaacattgtggaaatcgcggaccatctcttagaaccacaacagtcacaggaaagataatccatgaatggtgctgcagatcttgcacgttaccccctctacgtttcaaaggggaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtagggctattatttcgcagattaacatctagagaagttcttcttctcacggttggattgagtctggtggcatctgtagaactaccaaattccttagaggagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccggtgcttctgggatctcttggatgcaaaccactaaccatgtttctcataacagaaaacaaaatctggggaaggaaaagttggcctctcaacgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggtatttttggcagaaaaagaaacagagatcaggagtgttatgggacacacccagccctccagaagtggaaaaagcagtccttgatgatggcatttacagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatttcatatggaggaggttggaggtttcaaggatcctggaacacgggagaagaagtgcaggtgattgctgttgaaccggggaagaacccaaaaaatgtacagacagcgccaggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattgagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggtaatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggagagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgatgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctacatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaggtgaacccgctgacgctgacagcggcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctgggaggaggtaggagagggacgggagcccaaggggaaacactgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaatcaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaatcgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgtacaccaaaagcgaaacgaggcacagcacaaatcatggaggtgacagccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgccacatgcgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgagggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaagataagaaaagacataccgcaatgggaaccttcaaaaggatggaatgattggcaacaagtgcccttctgctcacaccacttccaccagctgattatgaaggatgggagggagatagtggtgccatgccgcaaccaagatgaactggtaggtagggccagagtgtcacaaggcgccggatggagcttgagagaaactgcatgtctaggcaagtcgtatgcacaaatgtggcagctgatgtacttccacaggagagacttgagactagcggctaatgccatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 5280 - RNA, 9879 nt, synthetic construct
  misc_feature 1..9879: note = derived and/or modified CDS sequence (wt) from DENV-1__AB189121__SS-prME
  source 1..9879: mol_type = other RNA
tctgtgaccatgctcttcatgctgctgcccacagccctggcgttccatctgaccacccgagggggagagccgcacatgatagttagcaagcaggaaagaggaaagtcacttttgtttaagacctctgcaggtgtcaacatgtgtacccttattgcaatggatttgggagagttgtgtgaggacacaatgacctacaaatgcccccggatcactgaaacagaaccagatgacgttgactgttggtgcaacgccacggagacatgggtgacttatggaacatgttctcaaactggtgaacaccgacgagacaaacgttctgttgcactggcaccacacgtagggcttggtctagaaacaagaaccgaaacgtggatgtcctctgaaggcgcttggagacaaatacaaaaagtggagacatgggctctgagacacccaggattcacggtgatggctctttttctagcacatgccataggaacatccatcacccagaaaggaattattttcattttgctgatgctggtaactccatccatggccatgcggtgcgtgggaataggtaacagagacttcgtggaaggactgtcaggagctacgtgggtggatgtggtactggagcatggaagttgcgtcactactatggcaaaagacaaaccaacactggatattgaactcttaaagacggaggtcacaaacccagccgtcctgcgcaaactgtgcattgaagccaaaatatcaaataccaccaccgattcgagatgtccaacacaaggagaagccacgctggtggaagaacaagacacgaactttgtgtgtcgacgaacgttcgtggacagaggctggggcaatggttgtgggctatttggaaaaggtagcttaataacgtgtgctaagtttaagtgtgtgacaaaactggaaggaaagatagtccaatatgaaaatttaaaatattcagtgatagtcaccgtccacactggagaccagcaccaagttggaaatgagactacagaacatggaacaactgcaatcataacacctcaagctcctacgtcggaaatacagctgacagactacggagctctaacactggactgttcacctagaacagggctagactttaatgagatggtgttattgacaatgaaagaaaaatcatggctcgttcacaaacaatggtttctagacttaccgctgccttggacctcgggggcttcaacatcccaagagacttggaatagacaagacttgctggtcacatttaagacagctcatgcaaagaagcaggaagtagttgtactaggatcacaagaaggagcgatgcacactgcgctgactggagcaacagaaatccaaacgtctggaacgacaacaattttcgcagggcacctgaaatgcagactgaaaatggataaactgactttaaaaggggtatcatatgtaatgtgcacaggctcattcaagctagaaaaggaagtggctgagacccagcatggaactgttctagtgcaggttaagtacgaaggaacagatgcaccatgtaagatccccttctcatcccaagatgagaagggagtaatccagaatgggagattgataacagccaaccccatagtcactgacaaagaaaaaccagtcaacattgaggcggagccaccttttggcgagagctacatcgtggtaggagcaggtgaaaaagccttgaaactaagctggttcaagaagggaagcagcatagggaaaatgtttgaagcaactgcccgtggagcacgaaggatggccattctgggagacactgcatgggacttcggttctataggaggagtgttcacgtccgtgggaaaactggtacaccagatttttggaactgcgtacggagttttgttcagcggtgtttcttggaccatgaaaataggaatagggattctgctgacatggctaggattaaattcaaggagcacgtccctttcaatgacgtgtatcgcagttggcatggtcacactgtacctaggagtcatggttcaggcggactcgggatgtgtaattaactggaaaggcagagaactcaaatgtggaagcggcatttttgtcactaatgaagttcacacctggacagagcaatacaaattccaggccgactccccaaagagactatcagcagccattgggaaggcatgggaggagggtgtgtgtggaattcgatcagccactcgtctcgaaaacatcatgtggaagcaaatatcaaatgaattaaaccacatcttacttgaaaatgacatgaaattcacagtggtcgtaggagatgtcagtgggatcttggcccaaggaaagaaaatgattaggccacaacccatggaacacaaatactcgtggaaaagctggggaaaagccaagatcataggagcagatgtacagaatatcaccttcatcatcgacggcccaaacacctcagaatgccctgataatcaaagagcatggaacatctgggaagttgaagactatggatttggaattttcacgacaaacatatggttgaaattgcgtgactcttatactcaagtgtgtgaccaccggctaatgtcagctgccattaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccagtatctcagcacaactacagaccaggatatttcacacaaacagcagggccatggcacttaggcaagttggaactagattttgatttgtgtgaaggtaccacagttgttgtggatgaaaattgtggaaatcgaggaccatctcttagaaccacaacagtcacaggaaagacaatccatgaatggtgctgtagatcttgcacgttaccccccctacgtttcaaaggggaagacgggtgctggtacggcatggaaatcagaccagtcaaggagaaggaagagaacctagttaagtcaatggtctctgcagggtcaggagaagtggatagtttttcactaggactgctatgcatatcaataatgatcgaagaggtaatgagatccagatggagcagaaagatgctgatgactggaacattggctgtgttcctccttctcacaatgggacaattgacatggaatgatctgatcaggctatgtatcatggttggagccaatgcttcagacatgatggggatgggaacaacgtacctagctttgatggctactttcagaatgagaccaatgttcgcagtcgggctcttatttcgcagattaacatctagagaagttcttcttcttacagttggattgagcctggtggcatctgtagaactgccaaattccttagaagagctaggggatggacttgcaatgggcatcatgatgttgaaattactgactgattttcagccacatcagctatgggctaccttgctgtctttaacatttgtcaaaacaactttttcattgcactatgcatggaagacaatggccatgatactatcaattgtgtctctcctccctttgtgcctgtccacgacttctcaaaaaacaacatggcttccggtgctgctgggatctcttggatgcaaaccactaaccatgcttcttataacagaaaacaaaatttgggggaggagaagttggcccctcaatgaaggaattatggctattggaatagttagcatcctactaagttcacttctcaaaaatgatgtgccactagctggcccactaatagctggaggcatgctaatagcatgttatgtcatatctggaagctcggccgacttatcactggagaaagcggctgaggtttcctgggaagatgaagcagaacactctggtgcctcacacaacatactagtggaggtccaagatgacggaaccatgaagataaaagatgaagagagagatgacacactcaccattctcctcaaagcaactctgttagcaatctcaggggtatacccaatgtcaataccggcgaccctctttgtgtggtatttttggcagaaaaagaaacagagatcaggagtgctatgggacacacccagccctccagaagtggaaagagcagtccttgacaatggcatttatagaattctccaaagaggattgttgggcaggtctcaagtaggagtaggagtttttcaagaaggtgtgttccacacaatgtggcacgtcaccaggggagctgttctcatgtaccaagggaagagattggaaccaagttgggctagtgtcaaaagagacttgatctcatatggaggaggttggaggtttcaaggatcctggaacacgggagaagaagtgcaggtgattgctgttgaaccggggaagaaccccaaaaatgtacagacaacgccaggcaccttcaagacccctgaaggtgaagttggagctatagctctagacttcaaacccggcacatctggatctcctatcgtgaacagagagggaaaaatagtgggtctttatggaaatggagtggtgacaacaagtggaacctacgtcagtgccatagctcaagctaaagcatcacaagaagggcccctaccagagattgaggacgaggtgtttaggaaaaggaatttaacaataatggacctacatccaggatcagggaaaacaagaagataccttccagccatagtccgtgaggccataaaaagaaagctgcgcacgctagtcttggcccccacaagagttgtcgcttctgaaatggcagaagcgctcaagggaatgccaataaggtatcagacaacagcagtgaaaagtgaacacacgggaaaggagatagttgatcttatgtgtcacgccactttcactatgcgtctcctgtctcctgtgagagtccccaattataacatgattatcatggatgaagcacatttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgaatggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaacaacgactgggactatgttgtcacaacagacatatccgaaatgggagcaaacttccgagccgacagggtaatagacccaaggcggtgcctgaaaccggtaatactaaaagatggtccagagcgtgtcatcctagctggaccgatgccagtgactgtggctagtgccgcccagaggagaggaagaattggaaggaacccaaataaggaaggtgatcagtatgtgtacatgggacagcctctaaacaatgatgaggaccacgcccattggacagaagcaaaaatgctccttgacaacataaacacaccagaagggatcattccagccctctttgagccggagagagaaaagagtgcagcaatagacggggaatacagattacggggtgaagcgaggaaaacgttcgtggagctcatgagaagaggagatctacctgtctggctatcctacaaagtcgcctcagaaggcttccagtactccgacagaaggtggtgctttgatggggaaaggaacaaccaggtgttggaggagaacatggacgtggagatttggacaaaagaaggagaaagaaagaaactacgaccccgctggctggatgccagaacatattctgacccactggctctgcgcgaattcaaagagttcgcagcaggaagaagaagtgtctcaggtgacctaatattagaaatagggaaacttccacaacatttaacgcaaaaagctcagaatgctttggataatctggttatgctgcacaactctgaacaaggaggaaaagcctacagacacgccatggaagaactaccagataccatagaaacattaatgctcctagctttgatagctgtgctgactggtggagtgacgttgttcttcctatcaggaagaggtctaggaaaaacatccattggcctactctgtgtgatggcctcaagtgcactgttgtggatggctagtgtggagcctcattggatagcggcctctatcatactggagttctttctgatggtgttgcttattccagagccagaccgacagcgcactccacaagacaaccagctagcatatgtggtgataggtttgttattcatgatattgacagtggcagccaatgagatgggattgttggaaaccacaaagaaagacctggggattggtcatgcagctgctgaaaaccaccaccatgctgcaatgctagacgtggacctacatccagcttcagcctggactctctatgcagtggccacaacaattatcactcccatgatgagacacacaattgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgctagtagctcactatgccataattggacctggactgcaggcaaaagctactagagaagctcaaaaaaggacagcagctggaataatgaaaaacccaactgttgacgggatcgttgcaatagatttggaccctgtagtttacgatgcaaaatttgaaaaacagctaggccaaataatgttgttgatactttgcacatcacagattctcctaatgcggaccacatgggccttgtgtgaatccatcacattggccactggacctctgaccacgctttgggagggatctccaggaaaattctggaacactactatagcggtgtccatggcaaacattttcaggggaagttatctagcaggagcaggtctggccttttcattgatgaaatctctaggaggaggtaggagaggcacaggagcccaaggagaaacgctgggagaaaaatggaaaagacagctaaaccaattgagcaaatcagaatttaacatttacaagaggagtgggattatagaggtggatagatctgaagccaaagaggggttgaaaagaggagaaacaaccaaacatgcagtgtcgagaggaacggccaaattgaggtggtttgtggagaggaaccttgtgaaaccagaagggaaagtcattgacctcggttgtggaagaggtggctggtcatattactgcgctgggctgaagaaagtcacagaagtaaaaggatacacgaaaggaggacctggacatgaggaaccaatcccaatggcaacctatggatggaacctagtaaagctacactccggaaaagatgtattctttacaccacctgagaaatgtgacacccttttgtgtgatatcggtgagtcctctccgaacccaactatagaagaaggaagaacattacgtgttctaaagatggtggaaccatggctcagaggaaatcaattttgcataaaaattctaaatccctacatgccgagcgtggtagaaactctggagaaaatgcaaaggaaacatggaggaatgctagtgcgaaatccactctcaagaaactccactcatgaaatgtactgggtttcatgtggaacaggaaacattgtgtcagcagtaaacatgacatctagaatgctgctaaaccgattcacaatggctcacaggaaaccaacatatgaaagagacgtggacttaggcgctggaacaagacatgtggcagtggaaccagaggtggccaacctagatatcattggccagaggatagagaatataaaaaatgaacacaaatcaacatggcattatgatgaggacaatccatacaaaacatgggcctatcatggatcatatgaggttaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgatacgcgcacaccaaaagcgaaacgaggcacagcgcaaattatggaggtaacagccaggtggttatggggttttctctctagaaacaaaaaacccagaatctgcacaagggaggagtttacaagaaaagttaggtcaaacgcagctattggagcagtgttcgttgatgaaaatcaatggaactcagcaaaagaggcagtggaagatgaacggttttgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcattggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggcaaaaatcactgacatcatggaacctgaacatgccctattggctacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcactaacatggaggcccaactaataagacaaatggagtctgagggaatcttttcacctagcgaattggaaaccccaaacctagctgaaagagtcttcgactggttggaaaaacatggcatcgagaggctgaaaagaatggcaatcagtggagatgactgtgtggtgaaaccaattgatgacagatttgcaacagccttaacagctttgaatgacatgggaaaggtaagaaaagacataccgcaatgggaaccctcaaaaggatggaacgattggcaacaagtgcctttttgttcacaccatttccaccagctgattatgaaggatgggagggagatagtggtgccatgccgcaaccaagatgaacttgtaggtagggccagagtctcacaaggcgccggatggagcttgagagaaactgcatgcctaggcaagtcatatgcacaaatgtggcagctgatgtacttccacaggagagatttgagactagcggctaatgccatctgttcagccgttccagttgactgggtcccaaccagccgcaccacctggtcgatccatgcccaccatcagtggatgacaacagaagacatgttgtcagtgtggaatagggtttggatagaggaaaacccatggatggaggacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaacgagaactatctagactatatgacatcaatgaagagattcaaaaacgagagtgatcccgaaggagcactctggtaa

SEQ ID NO: 5281 - RNA, 9879 nt, synthetic construct
  misc_feature 1..9879: note = derived and/or modified CDS sequence (wt) from DENV-1__AB195673__SS-prME
  source 1..9879: mol_type = other RNA
tctgtgaccatgctcctcatgctactgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgtcatagggacatccatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggaccatgaaaataggaatagggattctgctgacatggctgggattaaactcaaggagcacgtctctttcaatgacgtgtatcgcagttgggctgatcacactgtacctaggagtcatggtccaggcggactcgggatgtgtaatcaactggaaaggcagagaactcaaatgtggaagcggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttctcaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtctcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccagggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactgatttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttatagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggcttgttattcatgatattgacagtggcagccaatgagatgggattattggaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgacatgggaaaggtaagaaaagacataccgcaatgggaaccttcaaaaggatggaatgattggcaacaagtgcctttctgctcacaccacttccaccagctgattatgaaggatggaagggaaatagtagtgccatgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 5282 - RNA, 9879 nt, synthetic construct
  misc_feature 1..9879: note = derived and/or modified CDS sequence (wt) from DENV-1__AB204803__SS-prME
  source 1..9879: mol_type = other RNA
tctgtgaccatgctcctcatgctgctgcccacagtcctgacgttccatctgaccacccgagggggagagccgcacatgatagttagcaagcaggaaagaggaaagtcacttttgtttaagacctctgcaggtgtcaacatgtgcacccttattgcaatggatctgggagagttatgtgaggacacaatgacctacaaatgccctcggatcactgaaacggaaccagatgacgttgactgttggtgcaatgccacggagacatgggtgacctatggaacatgttctcaaactggtgaacatcgacgagacaaacgttctgtcgcactagcaccacacgtagggcttggtctagaaacaagaaccgaaacgtggatgtcctctgaaggcgcttggaaacaaatacaaaaagtggagacatgggctctgagacacccaggattcacggtgatagccctttttctagcacatgccataggaacatccatcacccagaaaggaattattttcattttgctgatgctggtaactccatccatggccatgcggtgcgtgggaataggaaacagagacttcgtggaaggattgtcaggagctacgtgggtggatgtggtgctggagcatggaagttgcgtcaccaccatggcaaaagacaaaccaacgctggacattgaacttttaaagacggaggtcacaaaccctgccgtcctgcgcaaattgtgcattgaagctaaaatatcaaacaccaccactgattcgagatgtccaacacaaggagaggccacgctagtggaagaacaagacacgaactttgtgtgtcgacgaacgttcgtggacagaggctgggggaatggttgtggactattcggaaaaggcagcttaataacgtgcgtcaagtttaagtgtgtgacaaaattggaaggaaagatagtccaatatgaaaacctaaaatattcagtgatcgttaccgtccacactggagaccagcaccaagttggaaatgagaccacagaacatggaacaattgcaaccataacacctcaagctcccacgtcagaaatacagctgacagactacggagctctaacactggattgctcacccagaacagggctagactttaatgagatggtgttgttgacaatgaaagaaaaatcatggctcgtccacaaacaatggtttctagacttaccactgccttggacctcaggggcttcaacatcccaagagacttggaatagacaagacttgctggtcacatttaagacagctcatgcaaagaagcaagaagtagtcgtactaggatcacaagaaggagcaatgcatactgcgttgactggagcgacagaaatccaaacgtctggaacgacaacaatttttgcaggacatctgaaatgtaggttaaaaatggataagctgactttaaaaggaacatcatatgtaatgtgcacaggcccattcaagttagagaaggaagtggctgagacccagcatggaactgttctagtacaggtcaaatacgaaggaacagatgcaccatgcaagatccccttctcgtcccaagatgagaagggagtaacccagaatggaagattgataacagccaaccccatagtcactgacaaagaaaaaccaatcaacattgaggcagagccaccctttggtgagagctacatcgtggtaggagtaggtgaaaaagctttgaaactaagctggttcaagaagggaagcagtatagggaaaatgtttgaagcaactgcccgtggagcacgaagaatggccattctgggagacaccgcatgggacttcggttctataggaggagtgttcacgtctatgggaaaactggtacaccagatttttggaactgcttatggagtcttattcagcggtgtttcttggaccatgaaaataggaatagggattctgctgacatggctaggactgaactcaaggagcacgtccctttcaatgacgtgtatcgcagtaggcatggtcacactgtacctaggagtcatggtccaggcggactcgggatgtgtaatcaattggaaaggcagagaactcaaatgtggaagcggcatttttgtcaccaatgaagttcatacctggacagagcaatacaaattccaggccgactccccaaagagactatcagcagccattgggaaggcatgggaggagggtgtgtgtggaattcgatcagccactcgtcttgagaacatcatgtggaagcaaatatcaaatgaattaaaccacatcttacttgaaaatgacatgaaatttacagtagtcgttggagacgtcagtgggatcttggcccaagggaagaaaatgattaggccacaacccatggaacacaaatactcgtggaaaagctggggaaaagccaaaatcataggagcagatgtacagaacactaccttcatcatcgacggcccaaataccccagaatgctctgatgaccaaagagcatggaacatctgggaagttgaagactatggatttggaatcttcacgacaaacatatggttgaaactgcgtgactcctacacccaagtgtgtgaccaccgactaatgtcagctgccatcaaggatagcagagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaattacagaccaggatacttcacacaaacagcagggccgtggcacttaggcaagttggaactggattttgatttgtgtgaaggtaccacagttgtcgtggatgaacaatgtggaaatcgaggaccatcccttagaaccacaacagtcacaggaaagataatccatgaatggtgctgtagatcttgcacattaccccccctacgcttcaaaggagaagacgggtgctggtacggtatggaaattagaccagtcaaggagaaggaagagaacctagtcaagtcaatggtctctgcagggtcaggagaagtggacagtttttcactaggactgttatgcatatcaataatgatcgaagaggtaatgagatccagatggagcagaaaaatgctgatgactggaacattggctgtgttcctccttctcacaatgggacaattaacatggaatgatctaatcaggctatgtatcatggttggagccaatgcttcagacaagatggggatgggaacaacgtacttggctttgatggccactttcagaatgagaccaatgttcgcagttgggctattattccgcggattaacatccagagaagttctccttctcacagttggattgagcttggtggcatctgtagaactaccaaattccctagaggagctaggggatggacttgcaatgggcattatgatgttaaaattactgactgattttcaatcacaccagctatgggctaccttgctgtctttaacatttgtcaaaacaactttttcattgcactatgcatggaagacaatggctatgacactgtcaattgtatctctcttccctttgtgcctgtccacgacctcccaaaaaacaacatggcttccggtgctgctgggatctcttggatgcaaaccattaaccatgtttctcataacagaaaataaaatctggggaaggaaaagttggcctctcaatgaaggaattatggctgttggaatagttagcatcctactaagttcacttctcaaaaatgatgtgccactagctggcccattaatagctggaggcatgctgatagcatgttatgtcatatccggaagctcggctgatctatcactggagaaagcggctgaggtctcttgggaagaagaagcagaacactctggtgcctcacataacatactagtagaggtccaagatgatggaaccatgaagataaaggatgaagagagagacgatacaatcaccatcctcctcaaagcaactttgctagcaatctcaggggtatacccaatgtcaataccggcgactctctttgtgtggtatttttggcagaaaaagaaacagagatcaggagtgctatgggacacacccagccctcctgaagtggaaagagcagtccttgacgatggtatttatagaattctccaaagaggattattgggcaggtctcaagtaggagtaggagtttttcaagaaggcgtattccacacaatgtggcacgtcaccaggggagctgtcctcatgtaccaagggaagagattggaaccaagttgggccagtgtcaaaaaagacctgatctcatatggaggaggttggaggtttcaaggatcctggaacacgggagaagaggtgcaggtgattgctgttgaaccggggaagaacccaaaaaacgtacagacagcgccgggtaccttcaagacctctgaaggcgaagttggagccatagctctagactttaaacctggcacatctggatctcctatcgtgaacagagagggaaaaatagtgggtctttatggaaacggagtggttacaacaagtggaacctatgtcagtgcaatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcctacaagagttgttgcttctgaaatggcagaggcgctcaagggaatgccaataaggtaccagacaacagcagtgaagagtgaacacacgggaaaggaaatagttgacctcatgtgccacgccactttcaccatgcgcctcctgtctcctgtgagagttcccaactacaacatgattattatggatgaagcacatttcaccgatccagccagcatagcagccagagggtacatctcaacccgagtgggtatgggtgaagcagctgcgattttcatgacagccactccccccggatcggtggaggcctttccacagagtaatgcagttattcaagatgaggaaaaagacattcctgaaagatcatggaactcaggctatgactggatcactgactttccaggcaaaacagtctggttcgttccaagcatcaaatcaggaaatgacatcgctaactgtttaagaaagaatgggaaacgggtgatccaattgagcagaaaaacctttgacactgagtaccagaaaacaaaaaacaatgactgggactatgttgtcacaacagatatatctgaaatgggagcaaactttcgagccgacagggtaatagacccaaggcggtgtctgaaaccagtaatactgaaagatggcccagagcgcgtcattctagccggaccaatgccagtgactgtggctagtgccgcccagaggagaggaagaattggaaggaaccaaaataaagaaggtgatcagtatatttacatgggacagcccctgaacaatgatgaggaccacgcccattggacagaagcaaaaatgctacttgacaacataaacacaccagaagggattatcccagccctctttgagccggaaagagaaaagagtgcagcaatagacggggaatacagactacggggcgaagcgaggaaaacattcgtggagctcatgagaagaggagacctacctgtctggctatcttacaaagttgcctcagaaggcttccaatactccgacagaaggtggtgctttgatggggaaaggaacaaccaggtgttggaggagaacatggatgtggagatctggacaaaagaaggagaaagaaagaaactacgaccccgctggctggacgccagaacatactctgacccactggctctgcgcgaattcaaagagttcgcagcaggaagaagaagcgtctcaggtgatctaatattagaaatagggaaacttccacaacatttaacgcaaaaagcccagactgctttggacaatctggtcatgctgcacaactctgaacaaggaggaaaagcctatagacacgccatggaagaactaccagacaccatagagacgttaatgctcctagctttgatagctgtgctgactggtggagtgacgctgttcttcctatcaggaaaaggcctagggaaaacatccattggcctactctgcgtgatgtcctcaagtgcactgttatggatggccagtgtggagccccattggatagcggcctctattatactggagttctttctgatggtgttgcttattccagagccagatagacagcgcactccacaagataaccagctagcatatgtggtgataggtttgctattcatgatattgacagtggcagccaatgagatggggttattggaaaccacaaagaaagacctggggattggccatgcagctgctgaaaaccaccaccacgctgcaatgctggacgtagacctacatccagcttcagcctggactctctacgcagtggccacaacgattattactcccatgatgagacatacaatcgaaaacacaacggcgaatatttccctgacagctattgcaaaccaggcagccatattgatgggacttgataagggatggccaatatcaaaaatggacataggagttccacttctcgctttggggtgctattctcaggtgaacccgctgacgctgacagcggcggtattgatgctagtagctcattatgccataattggacctggactgcaagcaaaagccacaagagaagctcaaaaaaggacagcagccggaataatgaaaaacccaaccgtcgacgggattgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacaatagcggtgtccatggcaaacatttttagaggaagttacctagcaggagcgggtctggccttctcattaatgaaatctctaggaggaggtaggagaggcacaggagcccaaggggaaacactgggagaaaaatggaaaagacagctaaaccaactgagcaagtcagaatttaacacttacaagaggagtgggatcatggaggtggatagatctgaagccaaagaggggttgaaaagaggagagacaaccaaacacgcagtgtcgagaggaacagccaaactgagatggttcgtggagaggaaccttgtgaaaccagaaggaaaagtcatagacctcggttgtggaagaggtggctggtcatattattgcgctgggctaaagaaagtcacagaagtgaaaggatacacaaaaggaggacctggacatgaggagccaatccccatggcaacctatggatggaacctagtaaagttacattccgggaaggatgtattcttcataccacctgagaaatgtgacacccttttgtgtgatattggtgagtcctctccgaacccgaccatagaagaaggaagaacgttacgtgttctaaaaatggtggaaccatggctcagaggaaaccaattttgcataaaaattttaaatccctacatgccgagtgtggtagaaaccctggagcaaatgcaaagaaaacatggaggaatgctagtgcgaaatccactctcaagaaattccactcatgaaatgtactgggtttcatgtggaacaggaaacattgtgtcagcagtaaacatgacatctagaatgctgctaaatcgattcacaatggcacacaggaaaccaacatatgaaagagatgtggacttaggcgctggaacaagacatgtggcagtagaaccagaggtagccaacctagatatcattggccagaggatagagaatataaaaaatgaacacaagtcaacatggcattatgatgaggacaatccgtacaaaacatgggcctatcatggatcatatgaggttaggccatcaggatcagcctcatccatggttaatggtgtggtgagactgctaaccaaaccatgggatgttattcccatggtcacacaaatagccatgactgacaccacaccctttgggcaacagagggtgtttaaagagaaagttgacacacgtacaccaaaagcgaaacgaggcacagcacaaattatggaggtgacagccaagtggttatggggtttcctctccagaaacaaaaaacccagaatctgcacaagagaggaatttacaaggaaagtcaggtcaaatgcagctattggagcggtgttcgttgatgaaaatcaatggaactcagcaaaagaggcagtggaagatgaacggttctgggaccttgtgcacagagagagggagcttcataaacaaggaaagtgtgccacgtgtgtctacaacatgatgggaaagagagagaaaaaactaggagagttcggaaaggcaaaaggaagtcgcgcaatatggtacatgtggttgggagcgcgcttcctagagtttgaagccctcggcttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaagccaagatcactgacatcatggaacctgaacatgccctactggccacgtcaatcttcaagctaacctaccaaaacaaggttgtgagggtgcagagaccagcaaaaagtggaactgtgatggatgtcatatccaggcgtgatcagagaggaagtggacaggttgggacctatggtttgaacaccttcaccaacatggaggcccaactaataagacaaatggagtccgagggaatcttttcacccagcgaactggaaaccccaaatctagccggaagagtcctcgactggttggaaaaacatggcatcgagaggctgaaaagaatggcaatcagcggagatgactgtgtggtgaaaccaattgatgacagatttgcaacagctttaacagctttgaatgacatggggaaggtaagaaaagacataccgcaatgggaaccttcaaaaggatggaatgattggcaacaggtgcctttctgctcacaccattttcatcagctgattatgaaggatgggagggaaatagtggtgccatgccgcagccaagatgaacttgtaggtagggccagagtatcgcaaggtgccggatggagcttgagagaaactgcatgtctaggcaagtcatatgctcaaatgtggcagctgatgtacttccacaggagagacttgagattagcagctaatgccatctgttcagccgttccagttgattgggtcccaaccagccgcaccacctggtcgatccatgcccaccatcaatggatgactacagaagacatgttgtcagtgtggaatagggtttggatagaggaaaacccatggatggaggacaaaactcatgtgtccagttgggaagacgttccatacctagggaaaagggaagatcaatggtgtggatccctaataggcctaacagcacgagccacctgggccactaacatacaagttgccataaaccaagtgagaaggctcatcgggaatgagaattatctagactacatgacatcaatgaagagattcaaaaacgagagtgatcccgaaggggcactctggtaa

SEQ ID NO: 5283 - RNA, 9879 nt, synthetic construct
  misc_feature 1..9879: note = derived and/or modified CDS sequence (wt) from DENV-1__LC016760__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggatacaatgacttacaaatgccctcgaatcactgaggcggaaccagatgacgttgattgttggtgcaatgccacagatacatgggtgacctatggaacatgttcccaaacaggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagacgtggtgctggaacatggaagttgcgtcactaccatggcaaaagacaaaccaacattggacattgaactcttgaagacggaagtcacaaaccctgccgtcctgcgcaaactgtgcattgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggctttttggaaaaggaagccttataacgtgtgctaagttcaagtgtgtgacaaaactggaaggaaaaatagttcaatatgaaaacttgaaatattcagtaatagtcaccgttcacactggagaccagcaccaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctttcgatgacgtgcattgcagttggcctagtaacgctatacttaggagtcatggttcaggcggattcaggatgtgtaatcaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtgcagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactatagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatagccatggtactgtcaattgtatctctcttccccttatgcctgtccacgacctcccaaaaaacaacatggcttccggtgctgttgggatctcttggatgcaaaccactaaccatgtttctcatagcagaaaataaaatctggggaaggaaaagttggcccctcaatgaaggaattatggctgttggaatagttagcatcctactaagttcactcctcaaaaatgatgtgccgctagctgggccactaatagctggaggtatgctaatagcgtgttatgttatatctggaagctcggccgatctatcactagagaaagcggctgaggtctcctgggaagaagaagcagaacactctggcgcctcacacaacatattagtggaggtccaagatgacggaaccatgaagataaaggatgaagagagagatgacacgctaaccattctccttaaagcaactctgctagcagtttcaggggtgtacccactatcaataccagcgaccctttttgtgtggtacttctggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggtttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtgctgctatggatggccagtgtagagccccattggatagcggcttccattatactggagttcttcctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctttatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatacacaaaaggaggacctggacatgaagaaccagtcccaatggcgacctatggatggaacctagtaaagctgcactccgggaaagacgtattctttataccacctgagaaatgtgacaccctcttgtgtgatatcggtgagtcctctccaaacccaactatagaggaaggaagaacgctacgcgtcctaaagatggtggaaccatggcttagaggaaaccaattttgcataaaaattctgaatccctacatgcccagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgttgcagtggaaccagaggtagccaacctagatatcattggccagaggatagagaacataaaatgtgaacacaagtcaacatggcattatgatgaggacaatccttataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatacatacttagagacatatcaaagatttcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaactgctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatgaaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5284 - RNA, 9879 nt, synthetic construct
  misc_feature 1..9879: note = derived and/or modified CDS sequence (wt) from DENV-1__LC128301__SS-prME
  source 1..9879: mol_type = other RNA
tctgtgaccatgctcctcatgctgctgcccacagccctagcgtttcatctgaccacccggggaggagagccgcacatgatagttagcaagcaggaaagaggaaaatcacttttgtttaagacctctgcaggtgtcaacatgtgtacccttattgcaatggatttgggagagttatgtgaggacacaatgacctacaaatgccccaggatcactgagacggaaccagatgacgttgactgttggtgcaatgccacggagacatgggtgacctatggaacatgttctcaaactggtgaacaccgacgagacaaacgttccgtcgcattggcaccacacgtggggcttggcctagaaacaagaaccgaaacgtggatgtcctctgaaggcgcttggagacaaatacaaaaagtggagacttgggctctgagacacccaggattcacggtgatagccctttttctagcacatgctataggaacatccatcacccagaaaggaattattttcattttgctgatgctggtaactccatccatggccatgcggtgtgtgggaataggcaacagagacttcgtggaaggactgtcaggagctacgtgggtggatgtggtgctggagcatggaagttgcgtcaccaccatggcaaaagacaaaccaacactggacattgaactcctgaagacggaggttacaaaccctgcagtcctgcgcaaattgtgcattgaagctaaaatatcaaacaccaccactgattcgagatgtccaacacaaggagaagctacgctagtggaagagcaggacacgaactttgtgtgccgacgaacgttcgtggacagaggctggggtaatggttgtgggctattcggaaaaggcagcttaataacgtgtgcaaagttcaagtgtgtgacaaaactggaaggaaagatagtccaatatgaaaacctaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacaggactagactttaatgagatggtgttgttaacaatgaaagaaaaatcatggctcgtccacaaacaatggtttctggacctaccactgccttggacctcgggggcctcaacatcccaagagacttggaatagacaagacttgctggtcacatttaagacagctcatgcaaaaaagcaggaagtagtcgtactaggatcacaagaaggagcaatgcacactgcgctgactggagcgacagaaatccaaacgtctggaacgacaacaatttttgcaggacatttgaaatgcagactaaaaatggataaactgaccttaaaaggggtatcatatgtaatgtgcacagggtcattcaagctagagaaggaagtggctgagacccagcatggaaccgttctagtgcaggttaaatacgaaggaacagatgcaccatgcaagatccccttctcgtcccaagatgagaagggagtaacccagaatgggagattgataacagctaaccccatagtcactgacaaagaaaaaccagtcaatattgaagcggagccaccttttggtgagagctacctcgtggtaggagcaggtgaaaaagctttgaaactaagctggttcaagaagggaagtagtatagggaaaatgtttgaagctactgcccgtggagcacgaaggatggccatcctgggagacaccgcatgggacttcggttctataggaggggtgttcacgtctgtggggaaactgatacaccagatttttgggactgcgtatggagtcttgtttagcggggtttcttggaccatgaaaataggaatagggattctgctgacatggctagggttaaattcaaggagcacgtccctttcaatgacgtgtatcgcagttggcatggtcacactgtacctaggagtcatggttcaggcggactcgggatgtgtgatcaactggaaaggcagagaactcaaatgtggaagcggcatttttgtcaccaacgaagttcacacctggacagagcaatacaaattccaggccgactcccccaagagactatcagcggccattgggaaggcatgggaggaaggtgtgtgtgggatccgatcagccactcgtctcgagaacatcatgtggaagcaaatatcaaatgaattaaaccacatcttacttgagaatgacatgaaatttacagtggttgtaggagacgttaatggaatcttggcccaaggaaagaaaatgattaggccgcaacccatggaacacaaatactcgtggaaaagttggggaaaagccaaagtcataggagcagatgtacagaataccaccttcatcatcgacggcccaaacaccccagaatgccctgatgatcaaagagcatggaatatttgggaagtcgaagactatggatttggaattttcacgacaaatatatggttgaaattgcgtgactcctacactcaagtgtgtgaccaccgactaatgtcagctgccatcaaggatagcaaagcagtccatgctgacatggggtactggatagaaagtgaaaagaacgagacttggaagttgacaagagcctccttcatagaagttaagacgtgcatctggccaaaatcccacaccctatggagcaatggagtcttggaaagtgagatgataatcccaaagacgtatggaggaccaatatcccagcacaactacagaccaggatatttcacacaaacagcagggccgtggcacttgggcaagttagaactggactttggtttatgtgaaggtaccactgttgttgtggatgaacattgtggaaaccgaggaccatctcttagaaccacaacagtcacaggaaagataatccatgaatggtgctgtagatcttgcacgttaccccccctacgcttcaaaggagaagacgggtgctggtacggtatggaaatcagaccagtcaaggagaaggaagagaacttagtcaggtcaatggtctctgcagggtcaggagaagtggatagtttttcactaggactgctatgcatatcaataatgatcgaagaggtgatgagatccagatggagcagaaaaatgctgatgactggaacattggctgtgttcctccttcttataatgggacaattgacatggaatgatctgatcaggctatgtatcatggttggagccaatgcttcagacaagatggggatgggaacaacgtacctagctttgatggccacttttagaatgaggccaatgttcgcagtcgggctgctgtttcgcaggttaacatctagagaagttcttcttctcacagttggattgagtctagtggcatctgtggaactaccaaattccttggaagagctaggggatggacttgcaatgggcatcatgatgttgaaattactgactgactttcagtcacatcagctatgggctgccttgctgtctttaacatttgtcaaaacaactttttcactgcactatgcatggaagacaatggctatgatactgtcaatcatatctctcttccctttatgcatgtccacgacttctcaaaaaacaacatggcttcccgtgttgctgggatctcttggatgcaaaccactaactatgtttcttattacagaaaacaaaatctggggaagaaaaagctggcctctcaatgagggaattatggctgttgggatagttagcattcttctaagttcacttctcaaaaatgatgtaccactagctggcccactaatagctggaggcatgctgatagcatgttatgtcatatctggaagctcggccgatttatcactggagaaagcagctgaggtttcctgggaagaagaagcagaacactctggtgcctcacacaacatactagtggaggtccaagatgatggaactatgaagataaaagatgaagagagagatgacacacttaccattctcctcaaagcaactttgctagcaatctcaggggtatacccaatgtcaataccggctaccctctttgtgtggtatttttggcagaaaaagaaacagagatcaggagtgctatgggacacacccagccctccagaagtggaaagagcagtccttgatgatggcatttatagaattctccaaagaggattattgggcaagtctcaagtaggagtaggagttttccaagaaggtgtgttccacacaatgtggcacgtcaccaggggagctgtcctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaaccctaaaaatgtacagacagcgccaggcacctttaagacccctgaaggtgaagttggagccatagctctagattttaaacccggcacatctggatctcctattgtgaacagagaggggaaaatagtaggtctttatggaaatggagtggtgacaacaagcggaacctacgtcagtgccatagctcaagccaaagcatcacaagaagggcctctaccagagattgaggacgaggtgtttaggaaaagaaacttgacaataatggacctacatccaggatcaggaaaaacaagaagataccttccagccatagtccgtgaagctataaaaagaaagctacgcacactagtcttggctcccacaagagttgtcgcctctgaaatggcagaggcgctcaagggaatgccaataaggtaccagacaacagcagtgaaaagtgaacacacgggaaaagagatagttgacctcatgtgtcacgctacctttaccatgcgtctcctctctcctgtgagagttcccaattataatatgattatcatggatgaagcacatttcactgatccagccagcatagcagccagagggtacatctcaacccgagtgggtatgggtgaagcagctgcaattttcatgacagccactccccccggatcgatggaggcctttccacagagcaatgcagctatccaagatgaagagagagatattcctgaaaggtcttggaactcaggctatgactggattactgatttcccaggtaaaacagtttggtttgttccaagcatcaaatcaggaaatgacattgccaactgtttaagaaagaatgggaaacgggtggtccaattgagcaggaaaacctttgacactgagtaccagaagacaaaaaataacgactgggactatgttgtcacaacagacatatctgaaatgggagcaaacttccgagctgacagggtaatagacccaagacggtgcctaaaaccggtaatactgaaagatggtccagagcgtgtcattctagccggaccgatgccagtgactgtggctagcgccgcccagaggagaggaagaattggaaggaaccaaaataaggaaggagaccagtatatttacatgggacagcctctaaacaatgatgaggaccatgcccattggacagaagcaaaaatgctccttgacaacataaacacaccagaagggattatcccagccctctttgagccggagagagaaaagagtgcagcaatagacggggaatacagactacggggtgaagcgaggaaaaccttcgtagagcttatgagaagaggagatctacctgtctggctatcctacaaagttgcctcagaaggcttccagtactccgacagaaggtggtgctttgatggagaaaggaacaaccaggtgctggaggagaacatggacgtggagatctggacaaaagaaggagaaagaaagaaactacgaccccgctggctggatgccagaacatactctgacccactggctctgcgtgaattcaaagagttcgcagcaggaagaagaagcgtttcaggtgacctaatattagaaatagggaaacttccacaacatctaacgcaaagggcccagaatgccctggacaacctggttatgctgcacaattctgagcagggaggaaaagcctatagacacgccatggaagaactaccagacactatagaaacgttgatgcttctggctttgatagctgtgttgactggtggggtgacgttgttcttcctatcaggaaggggtctaggaaaaacatccattggtctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatattgacagtggcagccaatgagatgggattactggaaaccacaaagaaggacctagggattggccatgtagctgctgaaagccaccaccatgctgcaatgctggacgtagacctacatccagcttcagcctggaccctctacgcagtggccacaacaattatcactcccatgatgagacacacaattgaaaacacaacggcaaacatttccctgacagctatcgcaaaccaggcagctatattgatgggacttgacaagggatggccaatatcaaagatggacataggagttccccttcttgccctggggtgctattctcaggtaaacccgctgacgctgacagcggcggtgttgatgctagtggctcattatgccataattggacccggactgcaagcaaaagctactagggaagctcaaaaaaggacagcagctggaataatgaaaaacccaactgtcgatgggatcgttgcaatagatttggaccctgtggtttacgatgcaaaatttgaaaaacagctaggccaaataatgctgttgatactttgcacatcacagattcttctgatgcggaccacatgggccttgtgtgaatccatcacactagccactggacctctgactacactctgggagggatctccaggaaaattctggaacaccacgatagcggtgtccatggcaaacatttttaggggaagctatctagcaggagcaggtctggctttttcattaatgaaatctctaggaggaggtaggagaggcacgggagcccaaggggaaacactgggagaaaaatggaaaagacagctaaaccaattgagcaagtcagaattcaacacttacaaaaggagtgggatcatggaggtggatagatctgaagccaaagaggggttaaaaagaggagaaacgactaaacacgcagtgtcgagaggaacggccaaactgaggtggtttgtagagaggaaccttgtgaaaccagaagggaaagtcatagacctcggttgtggaagaggtggctggtcatattattgcgctgggctgaagaaagtcacagaagtgaaaggatatacgaaaggaggacctgggcatgaggaaccaattccaatggcaacctatggatggaacctagtaaaactatactccgggaaggatgtattctttacaccacctgagaaatgtgacaccctcttgtgcgacattggtgagtcctctccgaacccaaccatagaagaaggaagaacgttacgtgtcctaaagatggtggaaccatggctcagaggaaaccaattctgcataaaagttctaaatccctacatgccgagcgtggtagaaactttggagcaaatgcaaagaaaacatggaggaatgctagtgcgaaatccactctcaagaaactccactcatgaaatgtattgggtttcatgtggaacaggaaacattgtgtcagcagtaaacatgacatctagaatgctgctaaaccgattcacaatgactcacaggaagccaacatatgaaaaagacgtggacttaggcgctggaacaagacatgtggcagtagaaccagaggtggccaacctagatatcattggccagaggatagaaaatataaaaaatgaacacaaatcaacatggcattatgatgaggataatccatacaaaacatgggcctatcatggatcatatgaagtcaagccatcaggatcagcttcatccatggttaatggtgtggtgagactgctgaccaaaccatgggatgtcatccccatggtcacacaaatagccatgactgacactacaccttttggacaacagagggtgttcaaagagaaagttgacacgcgcacaccaaaagcgaaacgaggcacagcacaaattatggaagtgacagctaggtggttatgggggtttctctctagaaacaaaaaacccagaatctgcacaagagaggagttcacaagaaaagttaggtcaaacgcagctattggagcagtgttcgttgatgaaaatcaatggaactcagcaaaagaggcagtggaggatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgtgcaatatggtacatgtggttgggagctcgcttcttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaacaaagtagtaagggtgcagagaccagcaaaaaatggaaccgtgatggatgtcatatccagacgtgaccagagaggaagtggacaggttggaacctatggcttaaacaccttcaccaacatggaggcccaactaataagacaaatggagtctgagggaatctttttacccagcgaactggaaaccccaaatctagctgaaagagtccttgactggttggaaaaacatggcactgagaggctgaaaagaatggcaattagtggagatgactgtgtggtgaaaccaattgatgacagattcgcaacagccttaacagctctgaatgacatggggaaggtaagaaaagacataccacaatgggaaccttcaaaaggatggaatgattggcaacaagtgcctttctgttcacaccatttccaccagctgatcatgaaggatgggagagagatagtggtgccatgccgcaaccaagatgaacttgtgggtagggccagagtatcacaaggcgccggatggagcctgagagaaactgcatgcctaggcaagtcatatgcacaaatgtggcagctgatgtacttccacaggagagacttgagattagcggctaatgctatctgttcagccgttccggttgattgggtcccaaccagccgcaccacctggtcgatccatgcccaccaccaatggatgacaacagaagacatgttgtcagtgtggaatagggtttggatagaggaaaacccatggatggaggacaaaactcatgtgtccagttgggaagacgttccatacctaggaaaaagggaggatcaatggtgtggatccctaataggcttaacagcacgagccacctgggccaccaacatacaagtggccataaaccaagtgagaaggctcattgggaatgagaattatctagactacatgacatcaatgaagagattcaagaacgagagtgatcctgaaggggcactctggtaa

SEQ ID NO: 5285 - RNA, 9879 nt, synthetic construct
  misc_feature 1..9879: note = derived and/or modified CDS sequence (wt) from DENV-1__LC011945__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggatacaatgacttacaaatgccctcgaatcactgaggcggaaccagatgacgttgattgttggtgcaatgccacagatacatgggtgacctatggaacatgttcccaaacaggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagacgtggtgctggaacatggaagttgcgtcactaccatggcaaaagacaaaccaacattggacattgaactcttgaagacggaagtcacaaaccctgccgtcctgcgcaaactgtgcattgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggctttttggaaaaggaagccttataacgtgtgctaagttcaagtgtgtgacaaaactggaaggaaaaatagttcaatatgaaaacttgaaatattcagtaatagtcaccgttcacactggagaccagcaccaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctttcgatgacgtgcattgcagttggcctagtaacgctatacttaggagtcatggttcaggcggattcaggatgtgtaatcaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtgcagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactatagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatagccatggtactgtcaattgtatctctcttccccttatgcctgtccacgacctcccaaaaaacaacatggcttccggtgctgttgggatctcttggatgcaaaccactaaccatgtttctcatagcagaaaataaaatctggggaaggaaaagttggcccctcaatgaaggaattatggctgttggaatagttagcatcctactaagttcactcctcaaaaatgatgtgccgctagctgggccactaatagctggaggtatgctaatagcgtgttatgttatatctggaagctcggccgatctatcactagagaaagcggctgaggtctcctgggaagaagaagcagaacactctggcgcctcacacaacatattagtggaggtccaagatgacggaaccatgaagataaaggatgaagagagagatgacacgctaaccattctccttaaagcaactctgctagcagtttcaggggtgtacccactatcaataccagcgaccctttttgtgtggtacttctggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggttcagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggtttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtgctgctatggatggccagtgtagagccccattggatagcggcttccatcatactggagttcttcctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctttatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatacacaaaaggaggacctggacatgaagaaccagtcccaatggcgacctatggatggaacctagtaaagctgcactccgggaaagacgtattctttataccacctgagaaatgtgacaccctcttgtgtgatatcggtgagtcctctccaaacccaactatagaggaaggaagaacgctacgcgtcctaaagatggtggaaccatggcttagaggaaaccaattttgcataaaaattctgaatccctacatgcccagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgttgcagtggaaccagaggtagccaacctagatatcattggccagaggatagagaacataaaatgtgaacacaagtcaacatggcattatgatgaggacaatccttataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatacatacttagagacatatcaaagatttcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaactgctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatgaaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5286 - RNA, 9879 nt, synthetic construct
  misc_feature 1..9879: note = derived and/or modified CDS sequence (wt) from DENV-1__LC011949__SS-prME
  source 1..9879: mol_type = other RNA
tccgtgaccatgctccttatgctggtgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgctacagacacatgggtgacctatggaacatgttcccaaactggcgagcaccgacgagacaaacgttccgtcgcactagccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgctgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggttgtgggctcttcggaaaaggaagccttataacgtgtgctaaattcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaagtcatggctagtccacaaacaatggtttctagacctaccactgccttggacctcgggagcttcaacatcacaagaaacttggaacagacaagatttgctggtgacatttaagacagcccatgcaaagaagcaggaagtagtcgtactaggatcacaagaaggagcaatgcacactgcgttgaccggagcgacagaaatccaaacgtctggaacaacaacaatttttgcaggacacttgaaatgtagactaaagatggacaaactgactctaaaagggacgtcatacgtgatgtgcacaggctcattcaagctagagaaagaagtggctgagacccagcacggaaccgttctagtgcagattaaatacgaaggaacagatgcaccatgcaagatccccttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtcactttcgatgacgtgcattgcagttggcctagtaacgctatacttaggagtcatggttcaggcggacacaggatgtgtaattaattggaaaggtagagaactcaaatgtggaagtggcatttttgtcaccaatgaagttcacacttggacagagcaatacaaatttcaagctgattccccaaagagactatcagcagccattgggaaagcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgccgggatcttggctcaaggaaaaaaaatgattaggccacaacccatggaatataaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccatcggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggcatggaaatcagaccagtcaaggaaaaggaagagaatctagtcaaatcaatggtttctgcagggtcaggggaagtggatagcttttcactaggactactatgcatatcaataatgatcgaagaggtgatgagatccagatggagtagaaaaatgctgatgactggaacactggctgtgttcttccttctcataatgggacaactgacatggaatgatctgatcagattatgcatcatggtcggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccctggaggagctgggggatggacttgcaatgggcattatgattttaaaattattgactgactttcaatcacatcagctgtgggctaccttgctgtccttgacatttatcaaaacaacgttttccttacactatgcatggaagacaatggctatggtactgtcaattgtatctctcttccccttatgcctgtccacgacctcccaaaaaacaacatggcttccggtgctattggggtctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatttctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggcgaagttggagccattgccctagactttaaacccggcacatctggatctcctatcgtgaacagagaagggaaaatagtaggtctttatggaaatggagtagtgacaacaagtggaacctacgttagtgccatagctcaagctaaagcatcacaagaagggcccctaccagagattgaagatgaggtgtttaagaaaagaaacttaacaataatggacctacatccaggatcggggaaaacaagaagataccttccagccatagtccgtgaagccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacatttcaccgatccgtctagcatagcggctagagggtacatctcaacccgagtgggcatgggtgaagcagctgcgatcttcatgacagccactcccccaggatcagtggaggccttcccacagagcaacgcagttatccaagatgaggaaagagacattcctgagaggtcatggaactcaggctacgagtggatcactgacttcccaggcaaaacagtttggtttgttccaagcattaaatcaggaaatgatattgccaactgcttaagaaagaatggaaaacgggtgatccaattgagcaggaaaacctttgacacagagtaccaaaaaacaaaaaataatgactgggactacgtcgtcacaacagacatctcagagatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggatcatcccagccctcttcgagccggagagagaaaagagtgcagcaatagacggggaatacagactgcggggtgaagcaaggaaaacgtttgtggagctcatgagaagaggagatttacctgtctggctatcctacaaagttgcctcagaaggctttcagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcatctcaggtgatctaatattagaaatagggaaacttccacaacacttgacgcaaagggcccagaatgccttggacaacctggttatgttgcacaactccgaacaaggaggaagagcctatagacatgcaatggaagagctgccagacaccatagaaacgctgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctccatcatactggagttcttcctgatggtgctgcttattccagaaccagacagacaacgcactccgcaggacaaccagctggcatatgtggtgataggtttgttattcatgatactgacagtagcagccaatgagatgggactgctggaaaccacaaagaaagacttagggattggccatgtggctgtcgaaaatcaccaccatgccgcaatgctggacgtagacctacatccagcttcagcctggaccctctatgcagtggccacaacaattatcactcccatgatgaggcacacaatcgaaaacacaacggcaaacatttccctgacagccatcgcaaaccaggcagctatattgatgggacttgataaaggatggccaatatcaaagatggacataggagttccacttctcgccttggggtgctattcccaggtgaatccactgacgctgacagcggcggtattgatgctagtggctcattacgctataattggacctggactgcaagcaaaagccactagagaagctcaaaaaaggacagcggccggaataatgaaaaatccaaccgttgatggaatcgttgcaatagatttggaccctgtggtttatgatgcgaaatttgagaagcaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagctaaagagggactgaaaagaggagaaacaaccaaacatgcagtgtcgagaggaaccgctaaattgaggtggtttgtggagaggaacctcgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttgtgtgacattggtgagtcctctccaaacccaactatagaggaaggaagaacgctacgcgtcctaaagatggtggaaccatggctcagaggaaatcaattctgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaatagattcacaatggctcacaggaaaccaacatatgaaagagacgtggacctaggcgccggaacaagacacgtggcagtggaaccagaggtagccaacctagatatcattggccagaggattgagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccttttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaatgaggccaaaattactgacatcatggaacccgaacatgccttactggctaaagcaatcttcaagctaacataccaaaataaagtggtaagggtacagagaccagcaaaaaatgggaccgtgatggatgtcatatccagacgtgaccagagaggaagtggccaggtcggaacttatggcttaaacactttcactaacatggaagcccagctgataagacaaatggagtctgagggaatctttttacccagtgaattagagaccccaaatttagctgagagagttctcgactggctggaaaaatatggcgtcgaaaggctgaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagatatgctgtcagtgtggaatagggtttggatagaggaaaacccatggatggaggataaaacccatatatccagttgggaagatgttccatatttggggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5287 - RNA, 9879 nt, synthetic construct
  misc_feature 1..9879: note = derived and/or modified CDS sequence (wt) from DENV-1__HM469966__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggttgtgggctcttcggaaaaggaagccttatgacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattacgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggtcggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaactattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctattgggatctcttggatgcaaaccactaaccatgtttcttatagcggaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagagaacgtgttccacacaatgtggcatgtcaccaggggagctgtactcatgtatcaagggaagagactagaaccgagctgggccagtgtcaaaaaagacctgatctcatatggaggaggttggaggcttcaaggatcctggaacacgggagaagaagtgcaggtgattgctgttgaaccagggaagaacccaaaaaatgtacaaacagcgccgggcacctttaagacccctgaaggcgaagttggagccattgccctagattttaaacctggcacatctggatctcccatcgtgaacagagaaggaaaaatagtaggtctttatggaaatggagtagtgacaacaagtggaacctacgtcagtgccatagctcaagctaaagcatcacaggaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaactcgagtgggcatgggtgaagcagctgcgatcttcatgacagccactcccccaggatcagtggaggcctttccacagagcaacgcagttatccaagatgaggaaagagacattcctgagagatcatggaactcaggctatgactggatcactgacttcccaggcaaaacagtttggtttgttccaagcattaaatcaggaaatgatattgccaactgcttaagaaagaatggaaaacgggtgattcaattgagcaggaaaacctttgacacagagtaccaaaaaacaaaaaataacgactgggactacgtcgtcacaacagacatctcagaaatgggagcaaatttccgggccgacagggtgatagacccaagacggtgtctgaaaccggtaatactaaaagatggtccagagcgtgtcgttttagcaggaccgatgccagtgactgtggccagtgccgctcagaggagaggaagaattggaaggaaccacaataaggaaggtgatcagtacatttacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaacgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatagccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggattgctggaaaccacaaagaaagacttagggattggccatgtggctgttgaaaatcaccaccatgccgcaatactggacgtagacttacatccagcttcagcctggaccctctatgcagtggccacaacaattatcactcccatgatgaggcacacaatcgaaaacacaacggcaaacatttccctgacagccattgcaaaccaggcagcgatattgatgggacttgacaaaggatggccaatatcaaagatggacataggagttccacttctcgccttagggtgctattcccaggtaaatccactgacgctgacagcggcggtattgatgctagtagctcattacgctataattggacctggactgcaagcaaaagctactagagaggctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctggaagggatctccaggaaaattttggaacaccacgatagcagtttccatggcaaacattttcaggggaagttatctagcaggagcaggtctggccttctcattaatgaaatccctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaaggggagaaacaaccaaacatgcagtgtcgaggggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgtactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaaatcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctaggaataagaaaccaagaatttgtacaagagaggagttcacaagaaaagttaggtcaaacgcagccatcggagcagtgttcgttgacgaaaatcaatggaactcagcaaaagaagcagtagaagatgagcggttctgggaccttgtgcatagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaagatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagagtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5288 - RNA, 9879 nt, synthetic construct
  misc_feature 1..9879: note = derived and/or modified CDS sequence (wt) from DENV-1__JX669462__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctcagcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaaaggaagtctattgacgtgtgccaagttcaagtgtgtgacaaaactagagggaaagatagttcaatatgaaaacttaaaatattcagtgatagtcactgttcacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttgggaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatactcatggaaaagctggggaaaagctaaaatcataggagcagacatacaaaataccaccttcatcatcgatggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactctcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttctcataacagaaaacaaaatctggggaaggaaaagttggcccctcaatgaaggaattatggctattggaatagtcagcattctactaagctcactcctaaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagctatagctctagatttcaaacccggcacatctggatctcccattgtgaacagagagggaaaaatagtgggtctgtatggaaatggagtggtgacaacaagtggaacctatgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctgggaattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgatacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaacactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaatatacaagtagccataaaccaagtgagaaggctcatcgggaatgagaattatttagattacatgacatcaatgaagagattcaagaatgagagtgatcccgaaggagcactctggtaa

SEQ ID NO: 5289 - RNA, 9879 nt, synthetic construct
  misc_feature 1..9879: note = derived and/or modified CDS sequence (wt) from DENV-1__JX669463__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctcagcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagctttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagactcagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttgggaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactctcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctaaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatatttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctgggaattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtgggagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaacactttcaccaatatggaggtccaactaataagacaaatggagtctgaaggaatctttttacccagtgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaatatacaagtagccataaaccaagtgagaaggctcatcgggaatgagaattatttagattacatgacatcaatgaagagattcaagaatgagagtgatcccgaaggagcactctggtaa

SEQ ID NO: 5290 - RNA, 9879 nt, synthetic construct
  misc_feature 1..9879: note = derived and/or modified CDS sequence (wt) from DENV-1__JX669464__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggatgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacgaacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgttcacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtccgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatacaaattccaggctgactccccaaaaagactgtcagcagccattggaaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgtcaatggaattttggcccaagggaaaaaaatgattagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggtggcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggccatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagattcctgaaggcgaagttggagccatagctctagattttaaacctggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagggttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttaccgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactatgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgctggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagccttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttctctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggccaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaactccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaatttttttacccagcgaattggaaacccccaatctggccaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtgtcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagaccaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5291 - RNA, 9879 nt, synthetic construct
  misc_feature 1..9879: note = derived and/or modified CDS sequence (wt) from DENV-1__JX669465__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagccaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacgctgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaaggaaaaaaaatgattagaccacaacccatggaacacaaatactcatggaaaagttggggaaaagctaagatcataggagcagacacacagaacaccacctttatcattgacggcccagatactccagaatgtcccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatgggttactggatagaaagtgaaaagaacgagacctggaagctagcgagagcctcctttatagaagtcaagacatgcatctggccgaaatcccacactctatggagtaatggagttttggaaagtgaaatggtaatcccaaagacatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggttgcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggcgtgttatgggacacacccagccctccggaagtggaaagggcagttcttgatgatggcatttatagaatcttgcaaagaggactgttgggcaggtcccaagtaggagtgggagttttccaagacggcgtgttccatacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggcaccttcaagactcctgaaggcgaagttggagccatagctctagattttaaacccggcacatccggatctcccatcgtgaacagagagggaaaaatagtaggtctttatggaaatggagtggtgacaacaagtggaacctacgttagtgccatcgctcaagctaaagcaacacaagaagggcctctaccagagattgaggacgaggtgtttaagaaaagaaacttaacaataatggacctgcacccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttaccgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctatgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggctgacagggtaatagatccaaggcggtgcttgaaaccggtaatactaaaggaaggcccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgccatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggccaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggcgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattcccgggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgcgtggtgaaaccaattgatgacaggttcgcaacagccttaacagctttgaatgatatgggaaaaataagaaaagacataccgcagtgggaaccttcaaaaggatggaatgactggcagcaagtccctttctgttcacaccacttccatcagctgatcatgaaggatggaagagaaatagtggtgccatgccgcaatcaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 5292 - RNA, 9879 nt, synthetic construct
  misc_feature 1..9879: note = derived and/or modified CDS sequence (wt) from DENV-1__JX669466__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctcagcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagttactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactatcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttgggaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggatttgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtactacagttgttgtagatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctaaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagccaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcctatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctgggaattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaacactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaatatacaagtagccataaaccaagtgagaaggctcatcgggaatgagaattatttagattacatgacatcaatgaagagattcaagaatgagagtgatcccgaaggagcactctggtaa

SEQ ID NO: 5293 - RNA, 9879 nt, synthetic construct
  misc_feature 1..9879: note = derived and/or modified CDS sequence (wt) from DENV-1__JX669467__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctgttgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtctacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5294 - RNA, 9879 nt, synthetic construct
  misc_feature 1..9879: note = derived and/or modified CDS sequence (wt) from DENV-1__HM469967__SS-prME
  source 1..9879: mol_type = other RNA
tctgtgaccatgctccttatgctgatgcctacggccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccattacccagaaagggattatttttattttgttaatgctggtaacaccatccatggccatgcgatgcgtgggaataggcagcagggacttcgtggaaggactgtcaggagcaacttgggtggatgtggtgctggaacatggaagctgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacgcaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcatactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccctatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctatagggggagtgttcacgtctgttggaaaattagtacaccagatttttggaactgcatatggagttttgttcagcggtgtttcctggaccatgaaaataggaataggggttctgctaacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgcggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaaaaaaatgattaggccacaacccatggaatacaaatactcgtggaaaagctggggaaaggctaaaatcataggggcagatgttcagaacaccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatttagttaaatcaatggtctctgcagggtcaggggaagtggatagcttttcactaggactgctatgcatatcgataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggtatcatgattttaaaactattgactgactttcaatcacatcagttgtgggctaccttgctgtccttgacatttatcaaaacgacgttttcattgcactatgcatggaagacaatggctatggtactgtcaattgtatctctcttccccttgtgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagctcagccgacctatcactagagaaagcagctgaagtctcctgggaagaagaagcagaacactctggtgcctcacataacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccaaaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgtagaaccagggaaaaaccccaaaaatgtacaaacagcgccgggcacctttaagacccctgaaggtgaaattggagccattgccctagattttaaacccggcacatctggatctcccatcgtgaacagagaaggaaaaatagtaggcctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacgagaagatatcttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacagggaaagagatagttgacctcatgtgtcacgccactttcaccatgcgccttctgtctcccgtgagagttcccaattacaacatgattatcatggatgaagcacattttaccgatccatctagcatagcggccagagggtacatctcaacccgagtgggcatgggtgaagcagccgcgatcttcatgacagccactcccccaggatcagtggaggcctttccacagagcaacgcagttatccaagacgaggaaagagacatccctgagagatcatggaactcaggctatgagtggatcactgactttccaggcaaaacagtttggtttgttccaagcattaaagcaggaaatgacattgccaactgcttaagaaagaatgggaaacgggtgattcaattgagcaggaaaacctttgatacagagtaccaaaaaacaaaaaatagcgactgggactacgtcgtcacaacagacatctccgaaatgggagcaaatttccgggccgacagggtaatagacccaagacggtgtctgaaaccggtaatactaaaagatggtccagagcgtgttattttagcaggaccgatgccagtgactgtggccagtgccgcccagaggagaggaagagttggaaggaaccacaacaaggaaggtgatcagtacatctacatgggacagcctttaaacaacgatgaagatcacgctcattggacagaagcaaaaatgctccttgataatataaacacaccagaagggattatcccagccctcttcgagccggagagagaaaagagtgcagcaatagacggggaatacagactgcggggtgaagcaaggaaaacgtttgtggaactcatgagaagaggagatctacctgtctggctatcctacaaagtagcctcagaaggcttccagtactctgacagaagatggtgttttgacggggaaaggaacaaccaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattggaaatagggaaacttccacaacacttgacgcaaagggcccagaatgccttggacaacctggttatgttgcacaattccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggctagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagatttagggattggccatgtggctgttgaaaatcaccaccacgccgcaatgctggacgtagacttacatccagcttcagcctggaccctctatgcagtggccacaacaattatcactcccatgatgaggcacacaattgaaaacacaacggcaaacatttctctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcgatagatttggaccctgtggtttatgatgcaaaatttgagaaacaactaggccaaataatgttgttgatactatgtacatcacagatcctcttgatgcggactacatgggccttgtgcgaatctatcacactggccactggacctctgaccacgctttggaagggatctccaggaaaattttggaacaccacgatagcggtttccatggcaaacattttcagaggaagttatctagcgggagcaggtctggccttctcattaatgaaatctctaggaggaggtaggagaggcacgggagcccaaggggaaacactgggagagaaatggaaaagacagctgaaccaactgagcaagtcagaattcaatacctataaaaggagtgggattatggaagtggacagatccgaagccaaagagggactgaaaagaggagaaacaaccaaacacgcagtgtcgagaggaaccgctaaactgaagtggtttgtggagaggaaccttgtgaaaccagaagggaaagtcatagacctcggttgtggaagaggtggctggtcatactattgcgctgggctgaagaaagtcacagaagtgaagggatatacaaagggaggacctggacatgaggaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaaaaaatcaattttgcataaaaattctgaatccttacatgccaagtgtggtggaaactctggagcaaatgcaaagaaaacatgggggaatgctagtacgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaacggcgtggtgaaactgctcaccaaaccatgggatgtcatccccatggtcacacaaatagccatgacagacaccacgccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaattcagcaaaagaagcagtggaagatgagcggttctgggaccttgtgcacagagagagggagcttcacaaacagggaaaatgtgccacgtgtgtttataacatgatggggaagagagagaaaaagctaggagagttcggaaaggcaaaaggaagtcgtgcaatatggtacatgtggttgggagctcgctttctagagttcgaagctctcggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctattggccaagtcaatcttcaagctaacctaccaaaataaggtggtaagggtacagagaccagcaaaaaatggaaccgtgatggatgtcatatccagacgtgaccagagaggaagtggccaggtcggaacttatggcctaaacactttcaccaacatggaagctcagctgataagacaaatggagtctgagggaatcttctcacccagcgaattagaaaccccaaatttagccgagagagttctcgactggctggaaaaatatggcgtcgaaaggctgaaaagaatggcaatcagcggagatgactgcgtagtgaaaccaattgatgataggtttgcaacagccttaacagctctaaatgatatgggaaaagtaagaaaagatataccacaatgggaaccttcaaaaggatggaatgattggcaaaaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcaatccatgcccatcaccaatggatgacaacagaagacatgctgtcagtgtggaatagggtttggatagaggaaaacccatggatggaggacaaaacccatatatccagttgggaagatgttccatacttgggaaaaagggaagatcaatggtgtggatccctgataggcttaacagcaagggccacctgggccaccaacatacaagtggccataaaccaagtgagaagattaattgggaatgagaattatctagattacatgacatcaatgaagagattcaagaacgagagtgatcccgaaggggcactctggtga

SEQ ID NO: 5295 - RNA, 9879 nt, synthetic construct
  misc_feature 1..9879: note = derived and/or modified CDS sequence (wt) from DENV-1__JX669468__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctgttgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggctgggattaaattcaaggagcacgtcactttcgatgacgtgcattgcagttggcatggttacactgtacctaggagtcatggttcaagcggactcgggatgtgtaatcaactggaagggcagagaactcaaatgtggaaatggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgatcattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtctacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgcgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5296 - RNA, 9879 nt, synthetic construct
  misc_feature 1..9879: note = derived and/or modified CDS sequence (wt) from DENV-1__JX669469__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattaaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagtctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacttgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggggtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatccgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaagctgactccccaaaaagactgtcagcagccattggaagggcatgggaggagggcgtgtgtggaattcgatcagccacgcgtcttgagaacatcatgtggaagcaaatatcaaatgaattgaaccacattctacttgaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtacggaggaccaatatctcagcacaactacagaccagggtatttcacacaaacagcagggccatggcacctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatggcacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttcttataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagaaagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctacagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacacgggagaagaagtgcaggtgatagctgttgaaccagggaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgatcattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattcctgagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatactggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcctgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggttaagccatcaggatcagcctcatctatggtgaatggagtggtgagattgctcacaaaaccatgggatgtcatccccatggtcacacaaatagctatgactgataccacaccctttggacaacagagagtgtttaaagagaaggttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcacaaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgactgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 5297 - RNA, 9879 nt, synthetic construct
  misc_feature 1..9879: note = derived and/or modified CDS sequence (wt) from DENV-1__JX669470__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagatgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcaccgtccacactggggatcagcaccaggtgggaaacgagaccacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaagggatgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgtagttggcatggttacactgtacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagctggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctgttggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacatcacacaacatattagtagaggtccaagatgatggaactatgaaaataaaagatgaagagagggatgacacactcactatactccttaaagcaaccttgctggcagtctcaggagtgtacccaatgtcaataccagcaactctttttgtgtggtatctttggcagaaaaagaaacagagatcaggagtgttatgggacacacccagccctccggaagtggaaagagcggttcttgacgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtaccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5298 - RNA, 9879 nt, synthetic construct
  misc_feature 1..9879: note = derived and/or modified CDS sequence (wt) from DENV-1__JX669471__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaacaaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaagggacgtcatatgtgatgtgcacaggctcatttaagctagagaaggaagtggctgagacccagcatggaaccgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgattatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactctcaaaatgagaccaatgttcgctgttgggctgctatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctttttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcatcctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcgggagtgtacccaatgtcaataccagcaactctttttgtgtggtatttttggcagaaaaagaaacagagatcaggagtgttatgggacacacctagccctccggaagtggaaagagctgttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgctatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaatatgattattatggatgaagcacattttaccgttccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgcaaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctgcactctggaaaagatgtattttttatgcctcctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgacagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagccgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgtcatatccagacgtgatcagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5299 - RNA, 9879 nt, synthetic construct
  misc_feature 1..9879: note = derived and/or modified CDS sequence (wt) from DENV-1__JX669472__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacatcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacatgaaattcacagtggttgtaggaaatgctaatggaattttggcccaagggaaaaaaatgattaagccacaacccatggaacacaaatactcatggaaaagctggggaaaagctaaaatcataggagcagacatacaaaataccaccttcatcatcgacggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatttctcagcacaactacagaccagggtatttcacacaaacagcagggccatggcatctaggcaagttggaattggattttgacttgtgtgaaggaaccacagttgttgtggatgaacattgtggaagtcgaggtccatctctcagaaccacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtagacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggactaccttactttctctgacatttatcaaaacaactctttcattggattacgcatggaagacaacggctacggtactgtcaatcgtatctctctttcctttatgcctgtctacgacctctcaaaaaacaacatggcttccagtgctgttaggatcttttggatgcaaaccattaaccatgtttctcataacagaaaacaaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcatgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacaggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcgaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgctatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgcagaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccgggaaaattctggaataccacgatagcagtatccatggcaaacatcttcaggggaagttatctagcaggagcaggtctggccttctcattaatgaaatctttaggaggaggtaggagaggtacgggagctcaaggggaaacattaggagagaaatggaaaagacagttaaaccaactgagcaagtcagaattcaacacctacaaaaggagtgggatcatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccaaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgagggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaacagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5300 - RNA, 9879 nt, synthetic construct
  misc_feature 1..9879: note = derived and/or modified CDS sequence (wt) from DENV-1__JX669473__SS-prME
  source 1..9879: mol_type = other RNA
tccgtgaccatgcttctcatgctgctgcccacagccctggcgttccatttgaccacacgaggaggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaactgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctccctcgtcggaaatacagctgactgactacggagccctcacattggactgctcacctaggacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgcaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacatgaaattcacagtggttgtaggaaatgctaatggaattttggcccaagggaaaaaaatgattaagccacaacccatggaacacaaatactcatggaaaagctggggaaaagctaaaatcataggagcagacatacaaaatgccaccttcatcatcgatggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaaccacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtagacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccagtgctgttaggatcttttggatgcaaaccattaaccatgtttctcataacagaaaacaaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacaggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcttttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaacgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcgaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgctagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgttgactggtggagtgacgttgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcagcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctattacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattaggagagaaatggaaaagacagttaaaccaactgagcaagtcagaattcaacacctacaaaaggagtgggatcatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccaaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacacgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagaccactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgctgaaaggctgaaaagaatggcaatcagcggagatgattgtgtagtgaaaccaattgatgatagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5301 - RNA, 9879 nt, synthetic construct
  misc_feature 1..9879: note = derived and/or modified CDS sequence (wt) from DENV-1__JX669474__SS-prME
  source 1..9879: mol_type = other RNA
tccgtgaccatgcttctcatgctgctgcccacagccctggcgttccatttgaccacacgaggaggagagccacacatgatagttagcaagcaggaaagaggaaagtcactcttgttcaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaactgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacatgaaattcacagtggttgtaggaaatgctaatggaattttggcccaagggaaaaaaatgattaagccacaacccatggaacacaaatactcatggaaaagctggggaaaagctaaaatcataggagcagacatacaaaatgccaccttcatcatcgatggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaacatctcagcacaactacagaccagggtatttcacacaaacagcagggccatggcatctaggcaagttggaattggactttgacttgtgtgaaggaaccacagttgttgtggatgaacattgtggaagtcgaggtccatctctcagaaccacaacagtcacaggaaagataatccatgaatggtgttgcagatcctgcacgttaccccccttacgtttcagaggagaagacggatgctggtatggtatggaaatcagaccagttaaggagaaggaggagaacctagttaggtcgatggtctctgcagggtcaggagaagtagacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattgtttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccagtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcaatctcaggagtgtacccaatgtcaataccagcaactctttttgtgtggtatttttggcagaaaaagaaacagagatcaggagtgttatgggacacacccagccctccggaagtggaaagagcggttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacaggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcttttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgattgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcgaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataatttggtcatgttgcacaattccgaacaaggaggaaaagcctatagacatgctatggaggaactaccagacaccatagaaacattgatgctcctggccttgatagctgtgttgactggtggagtgacgttgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctattacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattaggagagaaatggaaaagacagttaaaccaactgagcaagtcagaattcaacacctacaaaaggagtgggatcatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaaccaatcccaatggcgacctatggatggaacctagtgaagctgcactctggaaaagatgtattttttatgccacctgagaaatgtgacacccttctgtgtgatattggtgagtcctctccaaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcagctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5302 - RNA, 9879 nt, synthetic construct
  misc_feature 1..9879: note = derived and/or modified CDS sequence (wt) from DENV-1__JX669475__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactcttattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaatagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaggccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaagtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaaaggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaatccgatcagccacgcgtcttgagaacatcatgtggaagcaaatatcaaatgaattgaaccacattctactagaaaatgacataaaattcacagtggttgtaggaaatgctaatggaattttggctcaaggaaaaaaaatgattaggccacaacccatggaacacaaatactcatggaaaagctggggaaaagctaaaatcataggagcagacatacaaaacaccaccttcatcatcgacggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctatcatttcgcagactaacatccagagaagttcttcttctcacgattggattaagcctggtggcatccgtggagctaccaaactctttggaggagctaggggatggacttgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagctggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcgggagtgtacccaatgtcaataccagcaactctttttgtgtggtatttttggcagaaaaagaaacagagatcaggggtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtaaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaggaaaagaaacttaacaataatggacctccatccaggatcaggaaaaacaagaagatatcttccagccatagtccgtgaggccataaaaaggaaactgcgcacgttaatcttggctcccacaagagttgtcgcctctgaaatggcagaggcgctcaaaggaatgccaataagatatcagacaacagcagtgaagagtgagcacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccgggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgaataccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgttattttagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagccttgatagctgtgttgactggtggagtgacgctgttcttcctatcaggaaaaggtctagggaaaacatccattggcttgctctgtgtgacggcctcaagcgcactgttatggatggccagtgtggaaccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaatccattgacactgacagcggcggtgttgatgttagtggctcattatgccataattggaccaggactgcaagcaaaggccactagagaagctcaaaaaaggacagcagccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaggtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgttagtgcgaaacccactctcaagaaattccacccatgaaatgtactgggtttcatgtgggacaggaaacattgtgtcggcagtgaacatgacatccagaatgttgctgaatcgatttacaatggctcataggaagccaacatatgaaagagacgtggacttaggcgctggaacaagacatgtagcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggagtggtgagattgctcacaaaaccatgggatgtcatccccatggtcacacaaatagctatgactgacaccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaagggagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtacaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgactgtgtagtgaaaccaattgatgacagattcgcaacagcattaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaatcaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagtcccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggggcactctggtga

SEQ ID NO: 5303 - RNA, 9879 nt, synthetic construct
  misc_feature 1..9879: note = derived and/or modified CDS sequence (wt) from DENV-1__JX669461__SS-prME
  source 1..9879: mol_type = other RNA
tccgtgaccatgctcctcatgctgctgcccacagccctggccttccatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctggagaaggaagtggctgagacccagcatggaactgttttagtgcaggttaaatacgaaggaacagatgcaccatgcaagatcccttttttgacccaagatgagaaaggagtgacccagaatgggagattgataacagccaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacgctgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaagggaaaaaaatgattagaccacaacccatggaacacaaatactcatggaaaagttggggaaaagctaagatcataggagcagacatacagaacaccacctttatcattgacggcccagatactccagaatgtcccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatgggttactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcctccttctcataatgggacaactgacatggaatgatctgattaggttatgcatcatggttggagctaatgcttcagacaagatggggatgggaacaacgtacctagccttgatggctactctcaaaatgagaccaatgttcgctgttgggctattatttcgcagactaacatccagagaagttcttcttctcacggttggattaagcctggttgcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgcaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccatacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcacccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttaccgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctatgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcctgaaaccggtaatactaaaggaaggcccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggctggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgccatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacggaattgtcacaatagacttggatcctgtggtttatgatgcaaaatttgaaaaacagctaggccaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacagttaaaccaactgagcaagtcagaatttaacacctacaaaaagagtgggattatggaggtggacagatccgaagctaaagagggactgaaaagaggagaaacaaccaaacatgcagtgtcgagaggaacagccaaactgaggtggtttgtggagagaaacctcgtgaaaccagaagggaaagtcatagacctcggttgtggaagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggcgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgcgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 5304 - RNA, 9879 nt, synthetic construct
  misc_feature 1..9879: note = derived and/or modified CDS sequence (wt) from DENV-1__KF184975__SS-prME
  source 1..9879: mol_type = other RNA
tctgtgaccatgctccttatgctgatgcctacagccttggctttccatttgactacacgagggggagagccgcacatgatagtcagcaagcaggaaaggggaaagtcacttttgttcaagacctctgcaggtgtcaacatgtgcacccttattgcgatggatttgggagagttatgtgaggacacaatgacttacaaatgccctcgaatcactgaagcggaaccagatgacgttgactgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacactggacattgaactcttgaagacggaagtcacaaaccctgccgtcctgcgcaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactgacgtgtgctaagtttaagtgtgtgacaaaactggaaggaaagatagttcaatatgaaaacttgaaatattcagtgatagtcaccgtccacactgaggaccagcatcaggtgggaaatgaaaccacagaacatgggacaattgcaactataacacctcaagctcccacgtcggaaatacagctgaccgactacggagctcttacattggattgttcacctagaacaggattagacttcaatgaaatggtgttgttgacaatgaaagaaaaatcatggctagttcacaaacaatggtttctagacttaccactgccttggacctcgggagcttcaacatctcaggagacttggaacagacaagatttgttggttacatttaagacagctcatgcaaagaagcaggaagtagtcgtactgggatcacaagaaggagcaatgcacactgcgttgactggggcgacagaaatccagacgtcaggaacaacaacaatttttgcaggacatctgaaatgcagactaaaaatggataaactaactttaaaagggatgtcatatgtgatgtgcacaggctcatttaagttagagaaggaagtggctgagacccagcatggaaccgttttagtgcaggttaaatacgaaggaacagatgcaccatgcaagatccccttctcgatccaagatgagaaaggagtgatccagaatgggagattgataacagccaatcccatagtcactgacaaagaaaaaccagtcaacattgagacagaaccaccttttggtgagagctacatcgtggtgggggcaggcgaaaaaactctgaaactaagctggttcaaaaaaggaagcagcataggaaaaatgttcgaagcaaccgcccgaggagcacgaaggatggctattctaggagacaccgcatgggacttcggttccataggaggagtgttcacatctgtgggaaaactggtacaccaggttttcggaaccgcatatggggttttgttcagcggtgtctcttggaccatgaaaataggaatagggatcctgctgacatggctaggattaaattcaaggagcacgtcactttcaatgacttgcattgcagttggcatggtcacactgtacctaggagtcatggttcaggcggactcaggatgtgtaatcaattggaagggcagagaactcaaatgtggaagtggcatttttgtcactaacgaagtccacacttggacagagcaatacaaattccaagctgactccccaaaaagactgtcagcagccattgggaaggcatgggaggagggcgtgtgtggaatacgatcagccacacgtctggagaacgtcatgtggaagcaaatatcaaatgaattgaaccatattctacttgaaaacgacatgaaattcacagtggttgtgggagatgttaatggaatcttggcccaggggaagaaaatggttaggccacaacccatggaacacaaatactcatggaaaagttggggaaaagccaaaatcataggagcagatatacagaataccaccttcatcatcgacggtccagacactccagaatgccccgatgaccaaagagcatggaacatttgggaagttgaggactatgggtttggaatcttcacgacaaacatatggctgaaattgcgtgattcctacacccaaatgtgtgaccaccggctgatgtcagctgccatcaaggacagtaaggcagtccatgctgacatggggtactggatagaaagtgaaaagaacgagacctggaagctagcgagagcctcattcatagaagtcaagacatgcatctggccaaaatcccacactctatggagtaatggagttttggaaagtgaaatgataatcccaaagatatatggaggaccaacatctcagcacaactacagaccagggtatttcacacaaacagcaggaccatggcacctaggcaagttggaactagattttgatttgtgcgaaggcaccacagtagttgtggatgaacattgtggaaatcgaggtccatctcttagaaccacaacagtcacaggaaagataatccatgaatggtgttgtagatcctgcacgttaccccccttacgttttaaaggggaagacggatgttggtatggcatggaaatcagaccagtcaaggagaaggaagagaacctagtcaggtcaatggtctctgcagggtcaggagaagtggacaacttttcattgggactattatgtgtatcaataatggttgaagaagtgatgagatctagatggagtagaaagatgctgatgactggaacattggctgtttttctccttcttataatgggacaactgacatggaatgatctgattaggttatgcatcatggttggagctaatgcctcagacaggatggggatgggaacaacgtacctagccttgatggccaccttcaaaatgagaccaatgttcgctgttgggctattatttcgcagattaacatccagagaagtccttcttctcacaattggattaagcctggtggcatccgtggagctaccaaactctctagaggagctaggagatggacttgcaatgggcatcatgatgttaaaattactgaccgattttcagtcacaccagctatggaccaccttactgtccctgacatttgtcaaaacaactctttcattggattatgcatggaagacaatggccatggtgttgtcaatagtatctctctttcctttatgtttgtccacgacctctcaaaaaacaacatggcttccggtgctgttaggatcctttggatgcaaaccattaaccatgttcctcataacagaaaataaaatctggggaaggaagagttggcccctcaacgaaggaattatggctgttggaatagctagcattctattaagttcacttctaaaaaatgatgtgccgctagctggcccactaatagccggaggcatgctaatagcatgttatgtcatatccgggagctcagccgatttatctctggagaaagcggctgaggtctcctgggaagaagaagcagaacactctggcgcctcacacaacatcttagtggaggtccaagacgatggaactatgaaaataaaagatgaagagagagatgacacactcaccatactccttaaagcaactctgctggcagtttcaggggtgtacccaatgtcaataccagcaaccctttttgtgtggtatttttggcagaaaaagaaacagagatcaggagtgttatgggacacacccagccctccagaagcggaaaaagcagttcttgatgatggaatttatagaatcttgcaaagaggactgttgggcaggtcccaggtaggagtgggagtcttccaagatggcgtgttccacacaatgtggcacgtcaccaggggagctgtcctcatgtaccaagggaagagggtggaaccaagctgggctagtgtcaaaaaagacttgatctcatatggaggaggttggaggttccaaggactatggaacacgggagaagaagtgcaggtgatagccgttgaaccaggaaaaaaccccagaaatgtacagacaacaccaggcaccttcaagacccctgaaggcgaagtcggagccatagccctagactttaaacccggcacatctggatctcccatcgtaaacagagagggaaaaatagtgggtctctatggaaatggagtggtgacaacaagtggaacctacgttagtgccattgcccaagccaaagcatcacaagaagggcctctaccagagattgaggacgaggtgtttaggaaaagaaacttaacaataatggacctacatccagggtcaggaaaaacaagaagataccttccggccatagtccgtgaggccataaaaaggaaactgcgtacgctaatcttagctcccacaagagtcgtcgcctctgaaatggcagaggcgcttaaaggaatgccaataagatatcagacaacagcagtgaagactgaacacacgggaagggagattgttgacctcatgtgccacgccactttcaccatgcgtctcttatctccggtgagagttcccaattacaacatgattattatggacgaggcacatttcactgatccagccagcatagcagccagagggtatatctcaacccgagtgggcatgggtgaagcagctgcgatttttatgacggccactcccccaggatcgatggaggcctttccacagagcaatgcagttatccaagatgaggaaagagatattcctgagagatcatggaactcaggttatgattggatcaccgacttcccaggtaaaacagtctggtttgtcccaagcatcaaatcaggaaatgacattgccaactgtttaagaaagaacgggaaacgggtgatccagttgagcaggaaaacctttgacactgagtaccagaaaacaaaaaacaacgactgggactatgttgtcacaacagacatttccgaaatgggagcaaatttccgggctgacagggtaatagacccaaggcggtgcttgaagccggtaatactaaaagatggtccagagcgtgtcattctagccggaccgatgccagtgactgtggccagtgctgcccagaggagaggaagaattggaaggaaccaaaacaaggaaggtgatcaatatgtttacatgggacagcctttaaacaacgatgaggaccatgctcattggacagaagcgaaaatgctccttgacaatataaacacaccagaagggattattccagctctctttgagccggagagagaaaagagtgcagcaatagacggggagtacagactgaggggagaagcaaggaaaacgttcgtggagctcatgagaagaggagatctaccagtttggctatcttacaaggttgcctcagagggcttccaatactccgatagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattagaaatagggagacttccacaacatttgacgctaaaggcccagaatgctttggacaacttggtcatgttgcacaattccgaacaaggaggaaaagcctatagacatgccatggaagaactaccagacactatagaaacattgatgcttctagctttgatagctgtgctgactggtggagtgacgctattcttcctatcaggaaaaggtctagggaaaacatccattggcttactctgtgtgatggcctcaagcgtactgttatggatggccagtgtggagccccattggatagcggcctccatcatattagaattctttctgatggtgctgctcattccagagccagacagacagcgcactccgcaggacaaccaactagcgtatgtggtgataggcttgttattcataatattgacagtggcagccaatgagatgggattattggaaaccacaaagaaagacctggggattggccatgtggctgccgaagaccaccaacatgctacaatgctggacgtagatctacgtccagcttcagcctggaccctctatgcagtggccacaacaatcatcactcctatgatgagacacacaattgaaaacacaacggcaaacatttccctgacagctattgcaaaccaggcagccatattgatgggactagacaagggatggccgatatcgaagatggatataggggttccacttctcgctttaggatgctattctcaggtgaacccattaacactgacagcagcggtgttgatgctagtggctcattatgctataattggacctggattgcaagcaaaagccactagagaagctcagaaaaggacagcggctggaataatgaaaaatccaaccgtagacgggattgtcgcaatagatctggatcctgtggtttacgatacaaagtttgaaaaacagctgggtcaaataatgttactgatactttgcacatcacagattctcctgatgcggaccacatgggccttgtgtgaatccatcacactagctactggacccttgaccactctttgggagggatctccaggaaaattctggaacaccacgatagcagtgtctatggcaaacatcttcagaggaagttatctagcaggagcaggcctggccttttcattaatgaaatctttaggaggaggtaggagaggcacgggggctcaaggggaaacgctgggagaaaaatggaaaagacagctgaaccaactgagtaagtcagaattcaacacttacaagaggagcgggattactgaggtggacagatctgaagccaaagagggactgaagagaggagaaacaaccaaacatgcagtgtcgagaggagcagccaaactgaggtggttcgtggagagaaacctcgtgaaaccagaggggaaagtcatagaccttggttgtggaagaggtggctggtcatattactgcgctgggttgaagaaagtcacagaagtgaagggatacacaaaagggggacctggacatgaggaacccatcccaatggcgacctatggatggaacctagttaagctacactccggaaaagacgtattcttcataccacctgagaaatgtgatacccttttgtgtgatattggtgagtcctctccgaatccaaccattgaagaaggaagaacgttacgtgttctaaagatggtggaaccatggctcagaggaaatcaattttgcataaaaattctaaatccttacatgccaagtgtggtagaaaccctggagcaaatgcaaagaaaacatggagggatgttagtgcggaacccactatcaagaaattccacccatgaaatgtactgggtttcatgtggaacaggaaacattgtgtcggcagtgaacatgacatccagaatgttgctgaatcgattcacaatggctcacaggaagccaacatatgaaagagacgtggatttaggcgctggaacaagacatgtggcagtagaaccagaggtggccaacctagatatcattggccagaggatagagaatataaaaaatgaacacaagtcaacatggcattatgatgaggacaatccatacaaaacatgggcctatcatggatcatatgaggtcaagccatcaggatcagcctcatccatggtcaatggtgtagtgagactgctcaccaaaccatgggatgtcatccccatggtcacacaaatagctatgactgataccacaccctttggacaacagagggtgtttaaagagaaagttgatacgcgcacaccaagagcaaaacgaggcacagcacaaattatggaggtgacagccaagtggttatggggtttcctttctagaaacaaaaaacccagaatctgcacaagagaggagttcacaaggaaagtcaggtcaaatgcagcaattggagcagtgttcgttgatgaaaatcaatggaactcagcaaaagaagcagtggaagacgaaaggttttgggatcttgtgcacagagagagggagcttcataagcagggaaaatgtgccacgtgtgtctataatatgatggggaagagagagaaaaaattaggagagtttggaaaggcaaaaggaagtcgtgcaatatggtacatgtggttgggagcacgctttctagagttcgaagctcttggtttcatgaatgaagatcactggttcagtagagagaattcactcagtggagtggaaggagaaggactacacaaacttggatacatactcagagacatatcaaagattccagggggaaacatgtatgcagatgacacagctggatgggacacaagaataacagaggatgatcttcagaatgaagctaaaatcactgacatcatggagcccgaacatgctctattggctacatcaatctttaagctgacctaccaaaacaaggtggttagggtgcaaagaccagcaaaaagtggaaccgtgatggatgttatatccagacgtgaccagagaggaagtggacaggtcggaacttatggcttaaatactttcaccaacatggaggtccaactaataagacaaatggagtctgagggaatctttctacccagcgaattggaaacccccaacctagctgagagagctctcgactggttggaaaaacatggcgtcgaaaggctgaaaagaatggcaatcagcggagatgactgtgtggtgaaaccaactgatgacaggttcgcaacagccttaacagctctgaatgacatgggaaaagtaagaaaagacataccgcaatgggaaccttcaaagggttggaatgactggcagcaagtgcctttctgttcacaccatttccaccagctgatcatgaaggatgggagggagatagtggtgccatgccgcaaccaagatgaacttgtgggcagggccagagtatcgcaaggcgccggatggagcttgagagaaactgcttgcctaggcaagtcatatgcacaaatgtggcagctgatgtatttccacaggagagacctaagactggcggccaatgctatctgttcagccgttccagttgattgggtcccaaccagccgtaccacctggtcgatccatgcccaccatcaatggatgacaacagaggacatgttatcagtgtggaatagggtttggatagaggaaaacccatggatggaggacaaaactcatgtgtccagttgggaggacgttccatacttagggaaaagagaagatcagtggtgtggatccttgataggcttgacagctagggctacctgggccaccaacatacaagtagccataaaccaagtgagaaggcttattgggaatgagaattatctagattacatgacatcaatgaagagattcaagaatgaaagtgatcccgaaggggcactctggtaa

SEQ ID NO: 5305 - RNA, 9879 nt, synthetic construct
  misc_feature 1..9879: note = derived and/or modified CDS sequence (wt) from DENV-1__KT831765__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaacaggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggtagcagggacttcgtggaaggactgtcaggagcaacttgggtagacgtggtgctggaacatggaagttgcgtcactaccatggcaaaagacaaaccaacattggacattgaactcttgaagacggaagtcacaaaccctgccgtcctgcgcaaactgtgcattgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagccttataacgtgtgctaagttcaagtgtgtgacaaaactggaaggaaaaatagttcaatatgaaaacttgaaatattcagtaatagttaccgttcacactggagaccagcaccaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactgggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctaacatggttaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtgcagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaaccatagaccaggatatttcacacaaaccgcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgtatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatggccatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagttagcatcctactaagttcactcctcaaaaatgatgtgccgctagctgggccactaatagctggaggtatgctaatagcgtgttatgtcatatctggaagctcggccgatctatcactagagaaagcggctgaggtctcctgggaagaagaagcagaacactctggcgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacctgatctcatatggaggaggttggaggcttcagggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctgtatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattccagagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcatcaagcgtgctgctatggatggccagtgtagagccccattggatagcggcctccatcatactggagttcttcctgatggtgctgcttattccagagccagacagacaacgcactccgcaggacaaccagctggcatatgtggtgataggtatgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctattattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttgtaccacctgagaaatgtgacacccttttgtgtgatattggtgagtcctctccaaacccaactatagaggaaggaagaacgctacgcgtcctaaagatggtggaaccatggcttagaggaaaccaattttgcataaaaattctgaatccctacatgcctagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgtgacagtggaaccagaggtagccaacctagatatcattggccagaggatagagaacataaaatgtgaacacaagtcaacatggcattatgatgaggacaatccatataaaacatgggcctatcatggatcatatgaggtcaagccatcaggatcagcttcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaagtatggcgtcgaaaggctaaaaagaatggcaatcagtggagatgactgcgtagtgaaaccaattgatgataggtttgcaacagccctaacagctctgaatgatatgggaaaagtaagaaaagatataccacaatgggaaccctcaaaaggatggaatgattggcaacaagtacctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5306 - RNA, 9879 nt, synthetic construct
  misc_feature 1..9879: note = derived and/or modified CDS sequence (wt) from DENV-1__KP188567__SS-prME
  source 1..9879: mol_type = other RNA
tccgtgaccatgctcctcatgctgctacccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcatcttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccatcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactcgaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagacgcaccatgcaagatcccttttctgacccaagatgaaaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtctgtgggaaaattgatacatcaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtgggagacgttaatggaattttggcccaagggaaaaaaatgattaaaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatccctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatctagatggagtagaaagatgctgatgactggaacactggctgttttcctccttctcataatgggacaactgacatggaatgatctgatcaggttatgcatcatggttggagccaatgctttagacaggatggggatggggacaacgtacctagccttgatggccactttcaaaatgagaccaatgttcgctgttgggctattgtttcgcagactaacatccagagaagttcttcttctcacggttggattaagcctggtggcatccgtggagctaccaagctctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgcttgcagtctcaggagtgtacccaatgtcaataccggcaactctttttgtgtggtatttttggcagaaaaagaaacagagatcaggagtgctatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatcgctcaagctaaagcaacacaagaagggactctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccgataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgattttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttgaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaacaaccaggtgttggaggagaacatggacgtggagatctggacaaaggaaggagaaagaaagaaattgcgaccccgctggctggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgttgttcttcctatcaggaaaaggtctagggaaaacatccattggcctactctgtgtgatggcctcaagcgcactgttatggatggccagtgtggagccccattggatagcggcttccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggccaaataatgttactgatactttgtacatcacagattctcttgatgcggaccacatgggccttgtgtgaatccatcacactggccactggacccttgactactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctggactgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccttacaaaacatgggcctatcatggatcatatgaggtcaaaccatcaggatcagcctcatccatggtgaatggcgtggtgagattgctcactaaaccatgggatgtcatccccatggtcacacaaatagctatgactgataccacaccctttggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagtcaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaacgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgaggctagcggctaatgctatctgttcagccgtcccagctgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctaggaaaaagggaagatcaatggtgtggatccttgataggtttgacagcaagggccacctgggccactaatatacaagtagctataaaccaagtgagaaggctcatcgggaatgagaattatctagactatatgacatcaatgaagagattcaagaatgagagtgatcccgaaggggcactctggtaa

SEQ ID NO: 5307 - RNA, 9879 nt, synthetic construct
  misc_feature 1..9879: note = derived and/or modified CDS sequence (wt) from DENV-1__KP188568__SS-prME
  source 1..9879: mol_type = other RNA
tccgtgaccatgctcctcatgctgctgcccacagccctggccttccatttgactacacgagggggagagccacatatgatagtcagcaagcaggaaagaggaaagtcactcttgtttaagacctctgtaggtgtcaacatgtgcactctcatcgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcttggaaacaaatacaaaaagtggagacttgggctttgcgacacccaggattcacggtgatagcccttttcttggcgcatgccataggaacatccatcacccagaaagggatcattttcattttgctgatgctggtaacaccatcaatggccatgcgatgcgtaggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggttggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggacttcaatgagatggtgctactgacaatgaaagaaaaatcatggcttgtccacaaacaatggtttctagacttaccactgccctggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtaggctaaaaatggataaactgactttaaaagggatgtcatatgtgatgtgcacaggctcatttaagctagagaaggaagtggctgagacccagcatggaactgttttagtgcaggtcaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagtagcatagggaaaatgttcgaagcaaccgcccgaggagcacgaaggatggccatcctgggagacaccgcatgggacttcggctctataggaggattgttcacgtccgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaaccacatcctacttgaaaatgacatgaaattcacagtggttgtaggagacgttaatggaattttggcccaaggaaaaaaaatgatcagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaattagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcttccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacgtccagagaagttcttcttctcacggttggattaagcctggtggcatccgtggagctaccaaattctttagaggaactaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccataaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagaaagggatgatacactcaccatactcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggatgaggtgtttaagaaaagaaacttaacaataatggacctgcatccaggatcagggaaaacaagaagatatcttccatccatagtccgtgaggccataaaaaggaagctgcgcacgctaattttggctcccacaagagttgtcgcctctgaaatggcagaggcgctcaagggaatgccaataagatatcagacaacagcagtgaagagtgaacatacaggaagggagatagttgacctcatgtgccatgccacgtttaccatgcgtcttttatctccagtgagagttcccaattacaacatgattatcatggatgaagcacactttaccgatccagccagcatagcagccagagggtacatctcaacccgagtgggtatgggtgaagcagctgcgatcttcatgacagccactcccccaggatcggtggaggcctttccacagagcaatgcagctatccaagatgaggaaagagacattcctgagagatcatggaacacaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttatcctagccggaccgatgccagtgactgtggccagtgccgcccagaggagaggaagaattggaaggaaccaaaataaagaaggtgatcagtacatttacatgggacagcctttaaacaatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaagaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacacttgacgctaagagcccagaatgctctggacaacttggtcatgttgcacaattccgaacaaggaggaaaagcctacagacatgctatggaagaactaccagacaccatagaaacattgatgctcctagccttgatagctgtgctgactggtggagtgacgctgttcttcctatcaggaaaaggtctagggaaaacatccattggcctactctgtgtgatggcctcaagcgcactgttatgggtggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgacaagggatggccaatatcgaagatggatataggagttccacttctcgccttagggtgctattcccaggtgaacccattgacactaacagcggcggtgttgatgttggtggctcattatgccataattgggccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcggtgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactccgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcagcagtgaacatgacatccagaatgttactgaaccgattcacaatggctcacaggaagccaacatatgaaagagacgtggacttaggcgctgggacaagacatgtggcagtggaaccagaggtagccaacctagatattattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattactcaccaaaccatgggatgttattcccatggtcacacaaatagccatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaacactttcaccaatatggaggtccagttaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgataggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtgtcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 5308 - RNA, 9879 nt, synthetic construct
  misc_feature 1..9879: note = derived and/or modified CDS sequence (wt) from DENV-1__KF971870__SS-prME
  source 1..9879: mol_type = other RNA
tctgtgaccatgcttcttatgctgatgcccacagccttggcgttccatttgactacacgagggggagagccgcacatgatggttagcaagcaggaaagaggaaagtcacttctgtttaagacctcagcaggtgtcaacatgtgcacccttatagcgatggatttgggagagttatgtgaggacacaatgacttacaaatgccctcgaatcactgaggcggaaccagatgatgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggatttacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaattttgtgtgtcgacgaacgtttgtggatagaggctggggcaatggctgtgggctcttcggaaaaggaagccttataacgtgtgctaagttcaagtgtgtgacaaaattggaaggaaaaatagttcaatatgaaaacttgaaatattcagtaattgtcaccgtccacactggagaccagcaccaagtgggaaatgaaagcacagaacatgggacaactgcaactataacacctcaagctcccacgacggaaatacagctgaccgactacggagctcttacactggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacatttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaactcagaatgggagattgataacagccaaccccatagttactgacaaagaaaagccagtcaacattgaggcggaaccgccttttggtgagagttacattgtgataggagcaggtgaaaaagctttgaaactaagctggttcaagaaaggaagtagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcagggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccaccggcttatgtcatctgccatcaaggacagcaaggcagttcacgctgacatggggtactggatagaaagtgaaaagaacgatacctggaagctggccagagcctctttcatagaagtcaaaacatgtatttggccaaaatcccacactctatggagtaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgagggccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatttagtcaaatcaatggtctctgcagggtcaggggaagtggacagcttttcactgggactgctatgcatatcaataatgatcgaagaggtgatgagatctagatggagtagaaaaatgctgatgattggaacattggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaatcggattgagtctagtggcatctgcggagttaccaaattccttggaggagctgggggacggacttgcaatgggcattatgattttgaaattattgactgactttcaatcacatcagctgtgggctactttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagttcagccgacctatcactagagaaagcggctgaggtctcctgggaagaagaagcagaacactctggtgcttcacacaacatattagtggaggtccaagatgatggaaccatgaagataaaggatgaagagagagatgacacgctaaccattctccttaaagcaactctgctagcagtttcaggggtgttcccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccttaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataatgactgggactatgtcgtcacaacagacatctccgaaatgggagcaaatttccgggccgacagggtgatagacccaagacggtgtctgaaaccggtaatactaaaagatggtccagagcgcgtcatcttagcaggaccgatgccagtgactgtggccagtgctgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggatgtggagatctggacaaaagaaggagaaagagagaaactacgaccccgctggctgggtgccagaacatactcagacccactggctttgcgcgattttaaagagtttgcagcaggaagaagaagcgtctcaggtgatctaatattagaaatagggaaacttccacaacacttgacgcaaagggcccaaaatgccttggacaacctggtcatgttgcacaactcccaacaaggaggaagagcctatacacatgcaatggaagaactgccagacaccatagaaacgttgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggattggccatgtggctgttgaaaaccaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgctgatactatgcacatcacagatcctcttgatgcggactacatgggccttgtgcgaatccatcacgttggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacggctgaaccaactgagcaagtcagaatttaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatattattgcgctgggctgaagaaagtcacagaagtgaagggatatacaaaaggaggacctggacatgaagaaccaatcccaatggcgacctatggatggaacctagtaaagctgcattccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacacgtggcagtggaaccagaggtagccaacctagatatcattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaggagaaagttgatacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagagagcttcacaaacagggaaaatgtgccacgtgtgtttataacatgatggggaagagagagaaaaagttaggagagtttggaaaggcaaaaggaagtcgtgcaatatggtacatgtggttgggagcacgctttctagagttcgaagctcttggattcatgaacgaagaccactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagttgataagacaaatggagtctgagggaatcttttcacccagtgaattagagaccccaaatttagccgagagagttctagactggctgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctgggtggagcctgagagaaaccgcatgcctaggcaaatcatatgcacaaatgtggcagctgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccaattgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5309 - RNA, 9879 nt, synthetic construct
  misc_feature 1..9879: note = derived and/or modified CDS sequence (wt) from DENV-1__KF971871__SS-prME
  source 1..9879: mol_type = other RNA
tctgtgaccatgcttcttatgctgatgcccacagccttggcgttccatttgactacacgagggggagagccgcacatgatggttagcaagcaggaaagaggaaagtcacttctgtttaagacctcagcaggtgtcaacatgtgcacccttatagcgatggatttgggagagttatgtgaggacacaatgacttacaaatgccctcgaatcactgaggcggaaccagatgatgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggatttacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaattttgtgtgtcgacgaacgtttgtggatagaggctggggcaatggctgtgggctcttcggaaaaggaagccttataacgtgtgctaagttcaagtgtgtgacaaaattggaaggaaaaatagttcaatatgaaaacttgaaatattcagtaattgtcaccgtccacactggagaccagcaccaagtgggaaatgaaagcacagaacatgggacaactgcaactataacacctcaagctcccacgacggaaatacagctgaccgactacggagctcttacactggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacatttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaactcagaatgggagattgataacagccaaccccatagttactgacaaagaaaagccagtcaacattgaggcggaaccgccttttggtgagagttacattgtgataggagcaggtgaaaaagctttgaaactaagctggttcaagaaaggaagtagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcagggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccaccggcttatgtcagctgccatcaaggacagcaaggcagttcacgctgacatggggtactggatagaaagtgaaaagaacgatacctggaagctggcaagagcctctttcatagaagtcaaaacatgtatttggccaaaatcccacactctatggagtaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgagggccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatttagtcaaatcaatggtctctgcagggtcaggggaagtggacagcttttcactgggactgctatgcatatcaataatgatcgaagaggtgatgagatctagatggagtagaaaaatgctgatgattggaacattggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaatcggattgagtctagtggcatctgcggagttaccaaattccttggaggagctgggggacggacttgcaatgggcattatgattttgaaattattgactgactttcaatcacatcagctgtgggctactttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagttcagccgacctatcactagagaaagcggctgaggtctcctgggaagaagaagcagaacactctggtgcttcacacaacatattagtggaggtccaagatgatggaaccatgaagataaaggatgaagagagagatgacacgctaaccattctccttaaagcaactctgctagcagtttcaggggtgttcccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccttaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataatgactgggactatgtcgtcacaacagacatctccgaaatgggagcaaatttccgggccgacagggtgatagacccaagacggtgtctgaaaccggtaatactaaaagatggtccagagcgcgtcatcttagcaggaccgatgccagtgactgtggccagtgctgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaataaccaggtgttggaggagaacatggatgtggagatctggacaaaagaaggagaaagaaagaaactacgaccccgctggctgggtgccagaacatactcagacccactggctttgcgcgagtttaaagagtttgcagcaggaagaagaagcgtctcaggtgatctaatattagaaatagggaaacttccacaacacttgacgcaaagggcccaaaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggattggccatgtggctgttgaaaaccaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgctgatactatgcacatcacagatcctcttgatgcggactacatgggccttgtgcgaatccatcacgttggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacggctgaaccaactgagcaagtcagaatttaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatattattgcgctgggctgaagaaagtcacagaagtgaagggatatacaaaaggaggacctggacatgaagaaccaatcccaatggcgacctatggatggaacctagtaaagctgcattccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacacgtggcagtggaaccagaggtagccaacctagatatcattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaggagaaagttgatacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagagagcttcacaaacagggaaaatgtgccacgtgtgtttataacatgatggggaagagagagaaaaagttaggagagtttggaaaggcaaaaggaagtcgtgcaatatggtacatgtggttgggagcacgctttctagagttcgaagctcttggattcatgaacgaagaccactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagttgataagacaaatggagtctgagggaatcttttcacccagtgaattagagaccccaaatttagccgagagagttctagactggctgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctgggtggagcctgagagaaaccgcatgcctaggcaaatcatatgcacaaatgtggcagctgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccaattgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5310 - RNA, 9879 nt, synthetic construct
  misc_feature 1..9879: note = derived and/or modified CDS sequence (wt) from DENV-1__KF971869__SS-prME
  source 1..9879: mol_type = other RNA
tctgtgaccatgcttcttatgctgatgcccacagccttggcgttccatttgactacacgagggggagagccgcacatgatggttagcaagcaggaaagaggaaagtcacttctgtttaagacctcagcaggtgtcaacatgtgcacccttatagcgatggatttgggagagttatgtgaggacacaatgacttacaaatgccctcgaatcactgaggcggaaccagatgatgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggatttacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaattttgtgtgtcgacgaacgtttgtggatagaggctggggcaatggctgtgggctcttcggaaaaggaagccttataacgtgtgctaagttcaagtgtgtgacaaaattggaaggaaaaatagttcaatatgaaaacttgaaatattcagtaattgtcaccgtccacactggagaccagcaccaagtgggaaatgaaagcacagaacatgggacaactgcaactataacacctcaagctcccacgacggaaatacagctgaccgactacggagctcttacactggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacatttgaaatgtagactaaagatggacaaattgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaactcagaatgggagattgataacagccaaccccatagttactgacaaagaaaagccagtcaacattgaggcggaaccgccttttggtgagagttacattgtgataggagcaggtgaaaaagctttgaaactaagctggttcaagaaaggaagtagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcagggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccaccggcttatgtcagctgccatcaaggacagcaaggcagttcacgctgacatggggtactggatagaaagtgaaaagaacgatacctggaagctggcaagagcctctttcatagaagtcaaaacatgtatttggccaaaatcccacactctatggagtaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgagggccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatttagtcaaatcaatggtctctgcagggtcaggggaagtggacagcttttcactgggactgctatgcatatcaataatgatcgaagaggtgatgagatctagatggagtagaaaaatgctgatgattggaacattggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaatcggattgagtctagtggcatctgcggagttaccaaattccttggaggagctgggggacggacttgcaatgggcattatgattttgaaattattgactgactttcaatcacatcagctgtgggctactttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagttcagccgacctatcactagagaaagcggctgaggtctcctgggaagaagaagcagaacactctggtgcttcacacaacatattagtggaggtccaagatgatggaaccatgaagataaaggatgaagagagagatgacacgctaaccattctccttaaagcaactctgctagcagtttcaggggtgttcccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccttaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataatgactgggactatgtcgtcacaacagacatctccgaaatgggagcaaatttccgggccgacagggtgatagacccaagacggtgtctgaaaccggtaatactaaaagatggtccagagcgcgtcatcttagcaggaccgatgccagtgactgtggccagtgctgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggatgtggagatctggacaaaagaaggagaaagaaagaaactacgaccccgctggctggatgccagaacatactcagacccactggctttgcgcgagtttaaagagtttgcagcaggaagaagaagcgtctcaggtgatctaatattagaaatagggaaacttccacaacacttgacgcaaagggcccaaaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggattggccatgtggctgttgaaaaccaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgctgatactatgcacatcacagatcctcttgatgcggactacatgggccttgtgcgaatccatcacgttggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacggctgaaccaactgagcaagtcagaatttaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatattattgcgctgggctgaagaaagtcacagaagtgaagggatatacaaaaggaggacctggacatgaagaaccaatcccaatggcgacctatggatggaacctagtaaagctgcattccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacacgtggcagtggaaccagaggtagccaacctagatatcattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaggagaaagttgatacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagagagcttcacaaacagggaaaatgtgccacgtgtgtttataacatgatggggaagagagagaaaaagttaggagagtttggaaaggcaaaaggaagtcgtgcaatatggtacatgtggttgggagcacgctttctagagttcgaagctcttggattcatgaacgaagaccactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagttgataagacaaatggagtctgagggaatcttttcacccagtgaattagagaccccaaatttagccgagagagttctagactggctgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctgggtggagcctgagagaaaccgcatgcctaggcaaatcatatgcacaaatgtggcagctgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccaattgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5311 - RNA, 9879 nt, synthetic construct
  misc_feature 1..9879: note = derived and/or modified CDS sequence (wt) from DENV-1__JN903578__SS-prME
  source 1..9879: mol_type = other RNA
tccgtgaccatgctcctcatgctgctgcccactgccctggcgttccacttgaccacacgagggggagagccacacatgatagttagcaagcaggaaagaggaaagtcactcttgtttaagacctctgtaggtgtcaatatgtgcactctcattgcgatggatttgggagagttatgtgaagacacaatgacctacaaatgcccccggatcactgaggcggaaccagatgatgttgactgctggtgcaatgccacagacacatgggttacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaagagtggagacttgggctttgcgacacccaggattcacggtgatagcccttttcttggcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacgaacgttcgtggacagaggctggggcaatggttgcggactatttggaaaaggaagcctactgacgtgtgctaagttcaagtgtgtgacaaaactagaaggaaaggtagttcaatatgaaaacttaaaatattcagtgatagtcactgtccacactggggaccagcatcaggtgggaaacgagaccacagaacatggaacaattgcaaccataacacctcaagctccaacgtcggaaatacagctgaccgactacggagccctcacattggactgctcacctagaaccgggctggactttaatgagatggtgttattgacaatgaaagaaaaatcatggcttgtccacaaacaatggtttctagacttaccactgccttggacttcgggggcttcaacatcccaagagacctggaacagacaggacttgctggtcacattcaagacagctcatgcaaagaagcaggaagtagtcgtactgggatcacaggaaggagcaatgcacactgcgttgactggggcgacagaaatccagacgtcaggaacgacaacaatctttgcaggacacctgaagtgcagactaaaaatggataaactgactttaaaagggatgtcatatgtgatgtgcacaggttcatttaagctagagaaggaagtggctgagacccagcatggaactgttttagtgcaggttaaatacgaaggaacagatgcaccatgcaagatcccctttttgatccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagccggttcaagaaaggaagcagcatagggaaaatgttcgaagcaaccgcccgaggagcacgaaggatggctatcctgggagacaccgcatgggacttcggttctataggaggagtgtttacgtctgtgggaaaactgatacatcaggtttttgggaccgcatatggggttctgttcagcggtgtttcttggaccatgaaaataggaatagggattctgctgacatggttgggattaaattcaaggagcacgtcactttcaatgacgtgcattacagttggcatggtcacactgtacctaggagtcatggttcaggcggactcgggatgtgtaatcaactggaagggcagagaactcaaatgtggaagtggcatttttgtcaccaatgaagtccacacctggacagagcaatacaaatttcaggctgactccccaaagagattgtcagcagccattggaaaggcatgggaggagggcgtgtgtggaatccgatcagctacgcgtcttgagaacatcatgtggaagcaaatatcaaatgaattaaaccacatcttacttgaaaatgacatgaaattcacagtggttgtaggagatgctaatggaattttggcccaagggaaaaaaatgattagaccacaacccatggaacacaaatactcatggaaaagttggggaaaagccaaaatcataggagcagacatacagaacaccaccttcatcattgacggcccagatactccagaatgtcccgatgaccagagagcatggaacatctgggaagttgaggactatggattcggaattttcacgacaaacatatggctgaaattgcgtgactcctacacccaaatgtgtgaccaccggctaatgtcagctgccatcaaggacagcaaggcagtccatgctgatatggggtactggatagaaagtgaaaagaacgagacctggaagctagcgagagcctcctttatagaaatcaagacatgcatctggccgaaatcccacactctatggagtaatggagtcttggaaagtgaaatgataattccaaagatatatggaggaccaatatctcagcacaaccacagaccagggtatttcacacaaacagcaggcccatggcacctaggcaagttggaattggattttgatgtgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacggatgttggtatggcatggaaatcagaccagtcaaggagaaggaagagaatctagtcaggtcaatggtctctgcagggtcaggagaagtggatagtttttcattgggactactatgcgtgtcaataatgattgaagaagtaatgagatccagatggagtagaaagatgctgatgactggaacactggctgttttcttccttcttataatgggacaactgacatggaatgatctgatcagattatgcatcatggttggagccaatgtctcagacagaatggggatgggaacaacgtacctagccttgatggccactttcaaaatgagaccgatgttcgctgttgggctattatttcgcagactaacatccagagaggttctccttcttacaattggactaagcctggtggcatccgcggagctaccaaattctttagaggagctaggggacggactcgcaatgggcatcatgatgttaaaattattgactgattttcagtcacaccagttatggactaccttactgtctctgacattcatcaaaacaactctttcactggattatgcatggaagacaataactatgatactgtcaatcgtatctctctttcctctatgtctatccacgacctctcaaaaaacaacatggcttccggtgctgttaggatcctttggatgcaaaccactaaccatgtttcttataacagaaaacaaaatttggggaaggaaaagttggcccctcaatgaaggaattatggctgttggaatagtcagcattttactaagctcactcctcaaaaatgacgtgccactagccggcccactaatagctggaggcatgctaatagcatgttacgtcatatccggaagctcagccgatttatcattggagaaagcggctgaggtatcctgggaagaggaagcagaacactctggtacctcacacaacatactagtggaggtccaagatgatggaaccatgaaaataaaagatgaagagagagatgacacactcaccatactcctcaaagcaactctgctggcagtctcaggagtgtacccaatgtcaataccagcaactctttttgtgtggtatttttggcagaaaaagaaacagagatcaggggtgttatgggacacacccagccctccggaagtggaaagagcagttcttgatgatggcatttatagaatcttgcagagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatcgctcaagccaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaagctgcgcacgctaatcttggctcccacaagagttgtcgcctctgaaatggcagaggcgctcaaaggaatgccaataagatatcagacaacagcagtaaagagtgaacacacaggaagggagatagtcgacctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtggaggcctttccacagagtaatgcagttatccaagatgaggaaaaagacattcctgagagatcatggaactcaggctacgactggatcactgattttccaggcaaaacagtctggtttgttccaagcatcaaatcaggaaatgacattgccaactgtttaagaaagaacggaaaacgggtgattcaactgagcaggaaaacctttgacactgagtaccagaaaacaaaaaacaatgattgggactatgttgtcacaacagacatttccgaaatgggagcaaatttccgggccgacagggtaatagatccaaggcggtgcttgaaaccggtaatactaaaggatggtccagagcgcgtcattctagccggaccaatgccagtgactgtggctagtgctgcccagaggagaggaagaattggaaggaaccaaaacaaagaaggtgatcagtacgtttacatgggacagcctttaaataatgatggggatcacgctcattggacagaagcaaaaatgctccttgacaatataaacacaccagaagggatcatcccagccctctttgagccagagagagaaaagagtgcagcaatagacggggagtacagactgcggggagaagcaagaaaaacgttcgtggagctcatgagaagaggagatctaccagtttggctatcctacaaagttgcctcagaaggtttccaatattccgacagaagatggtgctttgatggggaaaggaacaaccaggtgttggaggagaacatggacgtggagatctggacaaaggaaggagaaagaaagaaattgcgaccccgctggttggatgctagaacttactctgatccactggctctgcgcgagtttaaagagttcgcagcaggaagaagaagtgtctcaggtgacctaatattggaaataggaaaacttccacaacatttgacgctgagagcccagaatgctttggataacttggtcatgttgcacaattccgaacaaggcggaaaagcctacagacatgctatggaggaactaccagacaccatagaaacattgatgctcctagccttgatagctgtgctcactggtggagtgacgctgttcttcctatcaggaaaaggtctagggaaaacatccattggcctactctgtgtgatggcctcaagcgcactgttatggatggccagtgtggagccccattggatagcggcctccatcatactagagttctttctgatggtgctgctcattccagagccagacagacagcgcactccacaggacaaccagttagcatatgtggtgataggtttgttattcatgatacttacagtggcagccaatgagatgggattattggaaaccacaaagaaagacctggggattggccatgtagccgccgaaaaccaccaccatgctacaatgctggacgtagacctgcgtccagcttcagcctggaccctctacgcagtagccacaacagttatcacccccatgatgagacacacaattgaaaatacaacagcaaatatttccctgacggccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggctactagagaagctcaaaaaaggacagcggccggaataatgaaaaatccaaccgtagacgggattgttgcaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctctgggaggggtctccaggaaaattttggaatactacgatagcagtgtccatggcaaacatcttcagaggaagttatctagcaggagcaggtctggccttctcattgatgaaatctttaggaggaagtaggagaggtacgggagctcaaggggaaacactgggagaaaaatggaaaagacagctaaaccaactgagcaagtcagaatttaacacctataaaaggagcgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatatacaaaaggaggacctggacatgaggagcccatcccaatggcgacctatggatggaacctagtaaagctacactctggaaaagatgtgttcttcataccgcctgaaaaatgtgacaccctcttgtgtgatatcggtgagtcctctccgaatccaactatagaagaaggaagaacgttacgtgtcctaaagatggtggaaccatggctcagaggaaaccaattctgcataaaaatcttaaatccttacatgccaagtgtggtagaaactctggagcaaatgcaaagaaaacatggagggatgctagtgcgaaacccactttcaagaaattccacccatgaaatgtactgggtttcatgtggaacaggaaacattgtgtcagcagtgaacatgacatccagaatgttactgaaccgattcacaatggcccacaggaagccaacatatgaaagagacgtggacctaggcgctggaacaagacatgtggcagtggaaccagaggtagccaacctagatatcattggccagaggatagagaatataaaaaatgaacacaagtcaacatggcactatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagccatgactgataccacaccattcggacaacagagggtgtttaaagagaaagttgacacacgcacaccaagagcaaaacgaggcacagcacaaattatggaggtgacagccaagtggttatggggtttcctttccagaaacaaaaaacccagaatctgcacaagagaggagttcacaagaaaagttaggtcaaacgcagcaataggagctgtgttcgttgatgaaaaccaatggaactcagcaaaagaagcagtggaagacgaaaggttttgggatctcgtgcacagagagagggagctccataaacagggaaaatgtgccacatgtgtttacaacatgatggggaagagagagaaaaaattaggagagttcggaaaagcaaaaggaagccgtgcaatatggtacatgtggctgggagcacgctttctagagtttgaagcccttggtttcatgaatgaagatcattggttcagtagagagaattcacttagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacatcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaatctttttacctagcgaattggaaactcccaatctagctaagagagttcttgactggttggagaaacatggtgctgaaaggctgaaaaggatggcaattagcggagatgattgtgtggtgaaaccaattgatgataggttcgcaacagccttaacagctctgaatgatatgggaaaagtaagaaaagacataccgcagtgggaaccttcaaaaggatggaatgactggcagcaagtgcctttctgttcacaccacttccaccagctgatcatgaaagatgggagggaaatagtggtgccatgccgcaaccaagatgaacttgtgggcagggctagagtatcacaaggtgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtctggatagaggaaaacccatggatggaggacaaaactcatgtatccagctgggaagaagttccatacctagggaaaagggaagatcaatggtgtggatccctgataggcttgacagcgagggccacctgggctaccaacatacaagtagccataaaccaggtgagaaggctcatcgggaatgagaattatctagattacatgacaacaatgaagagattcaagaatgagagtgatcccgaaggggcgctctggtaa

SEQ ID NO: 5312 - RNA, 9879 nt, synthetic construct
  misc_feature 1..9879: note = derived and/or modified CDS sequence (wt) from DENV-1__JN903579__SS-prME
  source 1..9879: mol_type = other RNA
tccgtgaccatgctcctcatgctgctgcccacagccctggcgttccatttgaccacacgagggggagagccacacatgatagttggcaagcaggaaagaggaaagtcactcttgtttaagacctctgcaggtgtcaacatgtgcaccctcattgcaatggatttgggagagttatgtgaggatacaatgacctacaaatgcccccggatcactgaagcagaaccagatgatgttgattgctggtgcaatgccacagacacatgggtgacctatgggacgtgttctcaaactggcgaacaccgacgggataaacgttcagtcgcattggccccacatgtggggcttggtctcgaaacaagaaccgaaacatggatgtcctctgaaggcgcctggagacagatacaaaaagtggagacttgggccttgagacacccaggattcacggtgatagccctttttctagcacatgccataggaacatccatcactcagaaagggatcatcttcattttgctgatgttggtgacaccatcaatggccatgcgatgcgtgggaataggcaacagagacttcgttgaaggactgtcaggagcaacatgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacactactactgattcaagatgtccaacacaaggagaagctacactggtggaagaacaagacgcgaactttgtgtgtcgacgaacattcgtggacagaggctggggtaatggctgtggactattcgggaagggaagcttactgacgtgtgctaagtttaagtgtgtgacaaaacttgaaggaaagatagttcaatatgaaaacttaaaatattcagtgatagtcactgtccacactggggaccagcaccaggtaggaaatgagactacagaacatggaacaattgcaaccataacacctcaagctcccacgtcggaaatacagctgactgactacggagcccttacattagactgttcacctagaacagggctggactttaatgagatggtgctgttgacaatgaaagaaaaatcatggcttgtccacaaacaatggtttctagacttaccactgccctggacctcgggagcttcaacatctcaagagacttggaacagacaagatctgctggtcacatttaagacagctcatgcgaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacgggctcatttaagctagagaaggaagtagctgagacccagcatggaactgtcctagtgcaggttaaatatgaaggaacagatgcaccatgcaagattccattttcaacccaagatgagaaaggagtgacccagaatgggagattgataacagccaatcccatagttactgacaaagaaaaaccagtcaacattgaaacagaaccaccttttggtgagagctacatcgtgataggggcgggtgaaaaagctttgaaactaagctggttcaagaaaggaagcagcatagggaaaatgttcgaagctaccgcccgaggagcacgaaggatggctatcctgggagacacagcatgggacttcggttccataggaggggtgttcacatctgtgggaaaattggtacaccaggtttttggaaccgcatatggggttttgttcagcggtgtttcttggaccatgaaaataggaatagggattctgctgacatggctaggattaaattcaaggagcacgtcactctcgatgacgtgcattgcagttggcatggtcacactgtacctaggagtcatggttcaagcggacacggggtgtgtgatcaactggaagggcagagaacttaaatgtggaagtggcatcttcgtcactaatgaagtccacacttggacagagcaatataaattccaggctgactccccaaaaagactatcagcagccattgggaaggcatgggaggaaggcgtgtgtggaattcgatcagccacacgccttgagaacatcatgtggaagcaaatatcaaatgaattgaaccatattctacttgaaaatgatatgaaattcacagtggttgtaggagacgctaatggaatcttgacccaaggaaaaaagatgattaggccacaacccatggaacacaaatactcatggaaaagctggggaaaagccaaaatcataggagcagatacacagaatactaccttcatcatagatggcccagacactccagaatgccccgatgaccagagagcatggaacatttgggaagttgaggactatgggtttggaattttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgagacctggaagctagcgagagcttccttcatagaagtgaagacatgcatctggccaagatcccacactctatggagcaatggagtcttggaaagtgaaatgataatcccaaagatatatggaggaccaatatcccagcacaactacagaccagggtatttcacacaaacagcagggccatggcacctaggcaagttggaactagactttaacttgtgtgaaggcaccacagttgttgtggatgaacattgtggaaatcgaggtccatctcttagaactacaacagtcacaggaaagataatccatgaatggtgttgtaggtcctgcacgctaccccccttacgcttcagaggagaagacggatgttggtatggcatggaaatcagaccagtcaaggagaaggaagagaatctagtcaggtcaatggtctctgcagggtcaggagaagtggatagtttttcattgggactactatgcgtgtcaataatgattgaagaagtaatgagatccagatggagtagaaagatgctgatgactggaacactggctgttttcttccttcttataatgggacaactgacatggaatgatctgatcagattatgcatcatggttggagccaatgtctcagacagaatggggatgggaacaacgtacctagccttgatggccactttcaaaatgagaccgatgttcgctgttgggctattatttcgcagactaacatccagagaggttctccttcttacaattggactaagcctggtggcatccgcggagctaccaaattctttagaggagctaggggacggactcgcaatgggcatcatgatgttaaaattattgactgattttcagtcacaccagttatggactaccttactgtctctgacattcatcaaaacaactctttcactggattatgcatggaagacaatagctatgatactgtcaatcgtatctctctttcctctatgtctatccacgacctctcaaaaaacaacatggcttccggtgctgttaggatcctttggatgcaaaccactaaccatgtttcttataacagaaaacaaaatttggggaaggaaaagttggcccctcaatgaaggaattatggctgttggaatagtcagcattttactaagctcactcctcaaaaatgacgtgccactagccggcccactaatagctggaggcatgctgatagcatgttacgtcatatccggaagctcagctgatttatcattggagagagcggctgaggtctcctgggaagaggaagcagaacactctggtgcctcacacaacatactagtggaggtccaagatgatggaactatgaaaataaaagatgaagagagagatgacacgctcactatactcctcaaagcaactttgttggcggtttcaggggtgtacccaatgtcaataccagcaaccctttttgtgtggtatttttggcagaaaaagaaacagagatcaggagtcttgtgggacacacccagccctccagaagtggaaagagcagttcttgatgatggtatctacagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggggtggtgacaacgagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagtcgatctcatgtgccacgccactttcaccatgcgtctcctatctccagtgagagttcctaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaatgggaaacgggtgatccaattgagcagaaaaaccattgacactgaataccagaaaacaaaaaacaatgattgggactatgttgtcacaacagacatttccgaaatgggagcaaatttccgggccgacagggtaatagacccaaggcggtgcttgaagccggtaatactaaaagatggtccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggatcacgcccattggacagaagcaaaaatgctccttgacaatataaacacgccagaagggattatcccagccctctttgagccagagagagaaaaaagtgcagcaatagacggggagtacagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggatgtggagatctggacaaaagaaggagaaagaaagaaattgcgacctcgctggttagatgccagaacctactctgacccactggccctgcgtgagtttaaagaattcgcagcaggaagaagaagtgtctcaggtgacctaatattagaaatagggaaacttccacagcatttgacgctaagggcccaaaatgctttggacaacttggtcatgttgcacaattccgaacaagggggaaaagcctatagacatgctatggaagaattaccagacaccatagaaacattgatgctactagctttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggttcgttattcatgatactgacagtggcagccaatgagatgggattactggaaaccacaaagaaagacctggggattggccatgtagtcgccgaaaaccaccaccatgctacaacgctagacatagacttacatccagcttcagcctggaccctctatgcagtagccacaacaattatcactcccatgatgagacacacaattgaaaacacaacggcaaatatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttatgatgcaaaatttgaaaaacagctaggccaaataatgttactaatactctgcacatcacagattcttttgatgcggactacatgggccttatgtgaatccatcacactggctactggacccttgaccactctctgggagggatctcctggaaaattctggaacaccacaatagcagtgtccatggcaaacatcttcaggggaagctatctagcaggagcaggtctggccttctcattaatgaaatctttgggaggaggtaggagaggtacgggagctcaaggggagacattgggagaaaaatggaaaagacaactaaaccaactgagcaagtcagaatttaatacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgtgctgggctgaagaaggttacagaagtgaagggatacacaaaaggaggacccggtcatgaggaacctatcccaatggcgacttatggatggaacatagtgaaactacactccggaaaggatgtattctttacaccacctgagaaatgtgacacccttttgtgtgacattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacgtatgaaagagacgtggacttaggcgctggaacaagacatgtggcagtggaaccagagatagccaacttagatattattggccagaggatagagaacataaaaaatgaacataagtcaacatggcattatgatgaggacaatccatacaaaacatgggcctatcatggatcatatgaggtcaagccatcagggtcagcctcatccatggtgaacggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgactgccaagtggttgtggggattcctctctagaaataaaaaacccagaatctgcacaagagaagagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacaaggaaaatgtgccacgtgtgtctacaacatgatggggaaaagagagaaaaaactaggagagtttggaaaggcaaaaggaagtcgtgcaatatggtacatgtggttgggagcacgctttctagagtttgaagcccttggcttcatgaatgaagaccactggttcagtagggagaattcactcagtggagtggaaggagaaggactatataaacttggatacatactcagagacatatcaaagattccagggggaaatatgtatgcagacgacacagctggatgggacacaagaataacagaggatgatcttcagaatgaggccaaaatcactgacatcatggaacccgaacatgctctactggctacgtcaatcttcaagctgacctatcaaaataaggtggtaagggtgcaaagaccagcaaaaagtggaaccgtgatggacgttatatccagacgtgaccagagaggaagtggacaggtcggaacttatggcttaaacactttcaccaacatggaggtccaactaataagacagatggaatctgaaggaatcttttcacccagcgaattggaaaactcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaagtgagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggccagagtatcacaaggcgctgggtggagcctgagagaaactgcttgcctgggcaagtcatatgcacaaatgtggcagctgatgtacttccacaggagagacctgagactggcggctaatgccatctgttcagccgttccagttaattgggtcccaaccagccgcaccacttggtcgatccatgcccatcaccaatggatgacaacagaagatatgttatcagtgtggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattattcagactacacgacatcaatgaagagattcaagaatgagagtgatcccgaaggagccctctggtaa

SEQ ID NO: 5313 - RNA, 9879 nt, synthetic construct
  misc_feature 1..9879: note = derived and/or modified CDS sequence (wt) from DENV-1__JN903580__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcagaaccagatgatgttgattgctggtgcaatgccacagacacatgggtgacctatgggacgtgttctcaaactggcgaacaccgacgggataaacgttcagtcgcattggccccacatgtggggcttggtctcgaaacaagaaccgaaacatggatgtcctctgaaggcgcctggagacagatacaaaaagtggagacttgggccttgagacacccaggattcacggtgatagccctttttctagcacatgccataggaacatccatcacccagaaagggatcatcttcattttgctgatgttggtgacaccatcaatggccatgcgatgcgtgggaataggcaacagagacttcgttgaaggactgtcaggagcaacatgggtggatgtggtactggagcatggaagctgcgtcaccaccatggcaaaaaataaaccaacattggatattgaactcttgaagacggaggtcacgaaccctgccgtcttgcgcaaactgtgcattgaagctaaaatatcaaacactactactgattcaagatgtccaacacaaggagaagctacactggtggaagaacaagacgcgaactttgtgtgtcgacgaacattcgtggacagaggctggggtaatggctgtggactattcgggaagggaagcttactgacgtgtgctaagtttaagtgtgtgacaaaacttgaaggaaagatagttcaatatgaaaacttaaaatattcagtgatagtcactgtccacactggggaccagcaccaggtaggaaatgagactacagaacatggaacaattgcaaccataacacctcaagctcccacgtcggaaatacagctgactgactacggagcccttacattagactgttcacctagaacagggctggactttaatgagatggtgctgttgacaatgaaagaaaaatcatggcttgtccacaaacaatggtttctagacttaccactgccctggacctcgggagcttcaacatctcaagagacttggaacagacaagatctgctggtcacatttaagacagctcatgcgaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacgggctcatttaagctagagaaggaagtggctgagacccagcatggaactgtcctagtgcaggttaaatatgaaggaacagatgcaccatgcaagattccattttcaacccaagatgagaaaggagtgacccagaatgggagattgataacagccaatcccatagttactgacaaagaaaaaccagtcaacattgaaacagaaccaccttttggtgagagctacatcgtgataggggcgggtgaaaaagctttgaaactaagctggttcaagaaaggaagcagcatagggaaaatgttcgaagctaccgcccgaggagcacgaaggatggctatcctgggagacacagcatgggacttcggctccataggaggggtgttcacatctgtgggaaaattggtacaccaggtttttggaaccgcatatggggttttgttcagcggtgtttcttggaccatgaaaataggaatagggattctgctgacatggctaggattaaattcaaggaacacgtcactctcgatgacgtgcattgcagttggcatggtcacactgtacctaggagtcatggttcaagcggacacggggtgtgtgatcaactggaagggcagagaacttaaatgtggaagtggcatcttcgtcactaatgaagtccacacttggacagagcaatataaattccaggctgactccccaaaaagactatcagcagccattgggaaggcatgggaggaaggcgtgtgtggaattcgatcagccacacgccttgagaacatcatgtggaagcaaatatcaaatgaattgaaccatattctacttgaaaatgatatgaaattcacagtggttgtaggagacgctaatggaatcttgacccaaggaaaaaagatgattaggccacaacccatggaacacaaatactcatggaaaagctggggaaaagccaaaatcataggagcagatacacagaatactaccttcatcatagatggcccagacactccagaatgccccgatgaccagagagcatggaacatttgggaagttgaggactatgggtttggaattttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgagacctggaagctagcgagagcttccttcatagaagtgaagacatgcatctggccaagatcccacactctatggagcaatggagtcttggaaagtgaaatgataatcccaaagatatatggaggaccaatatcccagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgttgtaggtcctgcacgctaccccccttacgcttcagaggagaagacggatgttggtatggcatggaaatcagaccagtcaaggagaaggaagagaatctagtcaggtcaatggtctctgcagggtcaggagaagtggatagtttttcattgggactactatgcgtgtcaataatgattgaagaagtgatgaaatccagatggagtagaaagatgctgatgactggaacactggctgttttcttccttcttataatgggacaactgacatggaatgatctgatcagattatgcatcatggttggagccaatgtctcagacagaatggggatgggaacaacgtacctagccttgatggccactttcaaaatgagaccgatgttcgctgttgggctattatttcgcagactaacatccagagaggttctccttcttacaattggactaagcctggtggcatccgcggagctaccaaattctttagaggagctaggggatggactcgcaatgggcatcatgatgttaaaattattgactgattttcagtcacaccagttatggactaccttactgtctctgacattcatcaaaacaactctttcactggattatgcatggaagacaatagctatgatactgtcaatcgtatctctctttcctctatgtctatccacgacctctcaaaaaacaacatggcttccggtgctgttaggatcctttggatgcaaaccactaaccatgtttcttataacagaaaacaaaatttggggaaggaaaagttggcccctcaatgaaggaattatggctgttggaatagtcagcattttactaagctcactcctcaaaaatgacgtgccactagccggcccactaatagctggaggcatgctgatagcatgttacgtcatatccggaagctcagctgatttatcattggagagagcggctgaggtctcctgggaagaggaagcagaacactctggtgcctcacacaacatactagtggaggtccaagatgatggaactatgaaaataaaagatgaagagagagatgacacgctcactatactcctcaaagcaactttgttggcgatttcaggggtgtacccaatgtcaataccagcaaccctttttgtgtggtatttttggcagaaaaagaaacagagatcaggagtcttgtgggacacacccagccctccagaagtggaaagagcagttcttgatgatggtatctacagaatcttgcaaagaggactgttgggtaggtcccaggtaggagtgggagtttttcaagacggcgtgttccgcacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggggtggtgacaacgagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagtcgacctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaacgggaaacgggtgatccaattgagcagaaaaacctttgacactgaataccagaaaacaaaaaacaatgattgggactatgttgtcacaacagacatttccgaaatgggagcaaatttccgggccgacagggtaatagacccaaggcggtgcttgaagccggtaatactaaaagatggtccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggatcacgcccattggacagaagcaaaaatgctccttgacaatataaacacgccagaagggattatcccagccctctttgagccagagagagaaaaaagtgcagcaatagacggggagtacagactgcggggagaagcaaggaaaacgttcgtggagctaatgagaagaggggatctaccagtttggctatcttacaaagttgcctcagaaggctttcagtactccgacagaagatggtgctttgacggggaaaggaacaaccaggtgttggaggagaacatggatgtggagatctggacaaaagaaggagaaagaaagaaattgcgacctcgctggttagatgccagaacctactctgacccactggccctgcgtgagtttaaagaattcgcagcaggaagaagaagtgtctcaggtgacctaatattagaaatagggaaacttccacagcatttgacgctaagggcccaaaatgctttggacaacttggtcatgttgcacaattccgaacaagggggaaaagcctatagacatgctatggaagaattaccagacaccatagaaacattgatgctactagctttgatagctgtgctgactggtggagttacgttgtttttcctatcaggaaaaggtctagggaaaacatccattggcttactttgtgtaatggcctcaagtgtactgttatggatggcaagtgtggagccccactggatagcggcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttatgatgcaaaatttgaaaaacagctaggccaaataatgttactaatactctgcacatcacagattcttttgatgcggactacatgggccttatgtgaatccatcacactggctactggacccttgaccactctctgggagggatctcctggaaaattctggaacaccacaatagcagtgtccatggcaaacatcttcaggggaagctatctagcaggagcaggtctggccttctcattaatgaaatctttaggaggaggtaggagagatacgggagctcaaggggagacattgggagaaaaatggaaaagacaactaaaccaactgagcaagccagaatttaatacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgtgctgggctgaagaaggttacagaagtgaagggatacacaaaaggaggacccggtcatgaggaacctatcccaatggcgacttatggatggaacatagtgaaactacactccggaaaggatgtattctttacaccacctgagaaatgtgacacccttttgtgtgacattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacgtatgaaagagacgtggacttaggcgctggaacaagacatgtggcagtggagccagagatagccaacttagatattattggccagaggatggagaacataaaaaatgaacataagtcaacatggcattatgatgaggacaatccatacaaaacatgggcctatcatggatcatatgaggtcaagccatcagggtcagcctcatccatggtgaacggcgtggtgagattgctcaccaagccatgggatgttatccccatggtcacacaaatagctatgactgataccacacccttcggacaacagagggttttcaaagagaaagttgacacacgcacaccaagaccgaaacgaggcacagcacaaattatggaggtgactgccaagtggttgtggggattcctctctagaaataaaaaacccagaatctgcacaagagaagagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacaaggaaaatgtgccacgtgtgtctacaacatgatggggaaaagagagaaaaaactaggagagtttggaaaggcaaaaggaagtcgtgcaatatggtacatgtggttgggagcacgctttctagagtttgaagcccttggcttcatgaatgaagaccactggttcagtagggagaattcactcagtggagtggaaggagaaggactatataaacttggatacatactcagagacatatcaaagattccagggggaaatatgtatgcagacgacacagctggatgggacacaagaataacagaggatgatcttcagaatgaggccaaaatcactgacatcatggagcccgaacatgctctactggctacgtcaatcttcaagctgacctatcaaaataaggtggtaagggtgcaaagaccagcaaaaagtggaaccgtgatggacgttatatccagacgtgaccagagaggaagtggacaggtcggaacttatggcttaaacactttcaccaacatggaggtccaactaataagacagatggaatctgaaggaatcttttcacccagcgaattggaaaactcaaatctagctgagagagttctcgactggttggagaaacatggcgtcgaaaggttgaaaagaatggcaatcagcggagatgactgtgtggtgaaaccaactgatgacaggttcgcaacagctttaacagccctgaatgacatgggaaaagtgagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggccagagtatcacaaggcgctgggtggagcctgagagaaactgcttgcctaggcaagtcatatgcacaaatgtggcagctgatgtacttccacaggagagacctgagactggcggctaatgccatctgttcagccgttccagttaattgggtcccaaccagccgcaccacttggtcgatccatgcccaccatcaatggatgacaacagaagatatgttatcagtgtggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattattcagactacatgacatcaatgaagagattcaagaatgagagtgatcccgaaggagccctctggtaa

SEQ ID NO: 5314 - RNA, 9879 nt, synthetic construct
  misc_feature 1..9879: note = derived and/or modified CDS sequence (wt) from DENV-1__JN903581__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcagaaccagatgatgttgattgctggtgcaatgccacagacacatgggtgacctatgggacgtgttctcaaactggcgaacaccgacgggataaacgttcagtcgcattggccccacatgtggggcttggtctcgaaacaagaaccgaaacatggatgtcctctgaaggcgcctggagacagatacaaaaagtggagacttgggccttgagacacccaggattcacggtgatagccctttttctagcacatgccataggaacatccatcacccagaaagggatcatcttcattttgctgatgttggtgacaccatcaatggccatgcgatgcgtgggaataggcaacagagacttcgttgaaggactgtcaggagcaacatgggtggatgtggtactggagcatggaagctgcgtcaccaccatggcaaaaaataaaccaacattggatattgaactcttgaagacggaggtcacgaaccctgccgtcttgcgcaaactgtgcattgaagctaaaatatcaaacactactactgattcaagatgtccaacacaaggagaagctacactggtggaagaacaagacgcgaactttgtgtgtcgacgaacattcgtggacagaggctggggtaatggctgtggactattcgggaagggaagcttactgacgtgtgctaagtttaagtgtgtgacaaaacttgaaggaaagatagttcaatatgaaaacttaaaatattcagtgatagtcactgtccacactggggaccagcaccaggtaggaaatgagactacagaacatggaacaattgcaaccataacacctcaagctcccacgtcggaaatacagctgactgactacggagcccttacattagactgttcacctagaacagggctggactttaatgagatggtgctgttgacaatgaaagaaaaatcatggcttgtccacaaacaatggtttctagacttaccactgccctggacctcgggagcttcaacatctcaagagacttggaacagacaagatctgctggtcacatttaagacagctcatgcgaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacgggctcatttaagctagagaaggaagtggctgagacccagcatggaactgtcctagtgcaggttaaatatgaaggaacagatgcaccatgcaagattccattttcaacccaagatgagaaaggagtgacccagaatgggagattgataacagccaatcccatagttactgacaaagaaaaaccagtcaacattgaaacagaaccaccttttggtgagagctacatcgtgataggggcgggtgaaaaagctttgaaactaagctggttcaagaaaggaagcagcatagggaaaatgttcgaagctaccgcccgaggagcacgaaggatggctatcctgggagacacagcatgggacttcggctccataggaggggtgttcacatctgtgggaaaattggtacaccaggtttttggaaccgcatatggggttttgttcagcggtgtttcttggaccatgaaaataggaatagggattctgctgacatggctaggattaaattcaaggaacacgtcactctcgatgacgtgcattgcagttggcatggtcacactgtacctaggagtcatggttcaagcggacacggggtgtgtgatcaactggaagggcagagaacttaaatgtggaagtggcatcttcgtcactaatgaagtccacacttggacagagcaatataaattccaggctgactccccaaaaagactatcagcagccattgggaaggcatgggaggaaggcgtgtgtggaattcgatcagccacacgccttgagaacatcatgtggaagcaaatatcaaatgaattgaaccatattctacttgaaaatgatatgaaattcacagtggttgtaggagacgctaatggaatcttgacccaaggaaaaaagatgattaggccacaacccatggaacacaaatactcatggaaaagctggggaaaagccaaaatcataggagcagatacacagaatactaccttcatcatagatggcccagacactccagaatgccccgatgaccagagagcatggaacatttgggaagttgaggactatgggtttggaattttcacgacaaacatatggctgaaattgcgtgactcctacacccaaatgtgtgatcaccggctaatgtcagctgtcatcaaggacagcaaggcagtccatgctgacatggggtactggatagaaagtgaaaagaacgagacctggaagctagcgagagcttccttcatagaagtgaagacatgcatctggccaagatcccacactctatggagcaatggagtcttggaaagtgaaatgataatcccaaagatatatggaggacctatatcccagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgttgtaggtcctgcacgctaccccccttacgcttcagaggagaagacggatgttggtatggcatggaaatcagaccagtcaaggaggaggaagagaatctagtcaggtcaatggtctctgcagggtcaggagaagtggatagtttttcattgggactactatgcgtgtcaataatgattgaagaagtgatgaaatccagatggagtagaaagatgctgatgactggaacactggctgttttcttccttcttataatgggacaactgacatggaatgatctgatcagattatgcatcatggttggagccaatgtctcagacagaatggggatgggaacaacgtacctagccttgatggccactttcaaaatgagaccgatgttcgctgttgggctattatttcgcagactaacatccagagaggttctccttcttacaattggactaagcctggtggcatccgcggagctaccaaattctttagaggagctaggggatggactcgcaatgggcatcatgatgttaaaattattggctgattttcagtcacaccagttatggactaccttactgtctctgacattcatcaaaacaactctttcactggattatgcatggaagacaatagccatgatactgtcaatcgtatctctctttcctctatgtctatccacgacctctcaaaaaacaacatggcttccggtgctgttaggatcctttggatgcaaaccactaaccatgtttcttataacagaaaacaaaatttggggaaggaaaagttggcccctcaatgaaggaattatggctgttggaatagtcagcattttactaagctcactcctcaaaaatgacgtgccactagccggcccactaatagctggaggcatgctgatagcatgttacgtcatatccggaagctcagctgatttatcattggagagagcggctgaggtctcctgggaagaggaagcagaacactctggtgcctcacacaacatactagtggaggtccaagatgatggaactatgaaaataaaagatgaagagagagatgacacgctcactatactcctcaaagcaactttgttggcgatttcaggggtgtacccaatgtcaataccagcaaccctttttgtgtggtatttttggcagaaaaagaaacagagatcaggagtcttgtgggacacacccagccctccagaagtggaaagagcagttcttgatgatggtatctacagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagtcggagccatagccctagatttcaaacctggcacatctggatctcccatcgtgaacagagagggaaaaatagtaggtctttatggagatggggtggtgacaacgagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacactggaagggagatagtcgacctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaacgggaaacgggtgatccaattgagcagaaaaacctttgacactgaataccagaaaacaaaaaacaatgattgggactatgttgtcacaacagacatttccgaaatgggagcaaatttccgggccgacagggtaatagacccaaggcggtgcttggagccggtaatactaaaagatggtccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggatcacgcccattggacagaagcaaaaatgctccttgacaatataaacacgccagaagggattatcccagccctctttgagccagagagagaaaaaagtgcagcaatagacggggagtacagactgcggggagaagcaaggaaaacgttcgtggagctaatgagaagaggggatctaccagtttggctatcttacaaagttgcctcagaaggctttcagtactccgacagaagatggtgctttgacggggaaaggaacaaccaggtgttggaggagaacatggatgtggagatctggacaaaagaaggagaaagaaagaaattgcgacctcgctggttagatgccagaacctactctgacccactggccctgcgtgagtttaaagaattcgcagcaggaagaagaagtgtctcaggtgacctaatattagaaatagggaaacttccacagcatttgacgctaagggcccaaaatgctttggacaacttggtcatgttgcacaattccgaacaagggggaaaagcctatagacatgctatggaagaattaccagacaccatagaaacattgatgctactagctttgatagctgtgctgactggtggagttacgttgtttttcctatcaggaaaaggtctagggaaaacatccattggcttactttgtgtaatggcctcaagtgtactgttatggatggcaagtgtggagccccactggatagcggcctccatcatactagagttttttctgatggtgctgctcattccagagccagacaggcagcgtactccacaggacaatcaactagcatatgtggtgataggtttgttattcatgatattgacagtggcagccaatgagatgggattactggaaaccacaaagagagacctggggattggccatgtagtcgccgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttatgatgcaaaatttgaaaaacagctaggccaaataatgttactaatactctgcacatcacagattcttttgatgcggactacatgggccttatgtgaatccatcacactggctactggacccttgaccactctctgggagggatctcctggaaaattctggaacaccacaatagcagtgtccatggcaaacatcttcaggggaagctatctagcaggagcaggtctggccttctcattaatgaaatctttaggaggaggtaggagaggtacgggagctcaaggggagacattgggagaaaaatggaaaagacaactaaaccaactgagcaagtcagaatttaatacttacaaaaggagtggaattatggaggtggacagatctgaagccaaggagggactgaaaagaggagaaacaaccaaacatgcagtgtcgagaggaacagtcaaacttaggtggtttgtggagaggaaccttgtgaaaccagaagggaaagtgatagacctcggttgtggaagaggtggctggtcatattactgtgctgggctgaagaaggttacagaagtgaagggatacacaaaaggaggacccggtcatgaggaacctatcccaatggcgacttatggatggaacatagtgaaactacactccggaaaggatgtattctttacaccacctgagaaatgtgacacccttttgtgtgacattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacgtatgaaagagacgtggacttaggcgctggaacaagacatgtggcagtggagccagagatagccaacttagatattattggccagaggatagagaacataaaaaatgaacataagtcaacatggcattatgatgaggacaatccatacaaaacatgggcctatcatggatcatatgaggtcaagccatcagggtcagcctcatccatggtgaacggcgtggtgagattgctcaccaagccatgggatgttatccccatggtcacacaaatagctatgactgataccacacccttcggacaacagagggttttcaaagagaaagttgacacacgcacaccaagaccgaaacgaggcacagcacaaattatggaggtgactgccaagtggttgtggggattcctctctagaaataaaaaacccagaatctgcacaagagaagagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacaaggaaaatgtgccacgtgtgtctacaacatgatggggaaaagagagaaaaaactaggagagtttggaaaggcaaaaggaagtcgtgcaatatggtacatgtggttgggagcacgctttctagagtttgaagcccttggcttcatgaatgaagaccactggttcagtagggagaattcactcagtggagtggaaggagaaggactatataaacttggatacatactcagagacatatcaaagattccagggggaaatatgtatgcagacgacacagctggatgggacacaagaataacagaggatgatcttcagaatgaggccaaaatcactgacatcatggagcccgaacatgctctactggctacgtcaatcttcaagctgacctatcaaaataaggtggtaagggtgcaaagaccagcaaaaagtggaaccgtgatggacgttatatccagacgtgaccagagaggaagtggacaggtcggaacttatggcttaaacactttcaccaacatggaggtccaactaataagacagatggaatctgaaggaatcttttcacccagcgaattggaaaactcaaatctagctgagagagttctcgactggttggagaaacatggcgtcgaaaggttgaaaagaatggcaatcagcggagatgactgtgtggtgaaaccaactgatgacaggttcgcaacagctttaacagccctgaatgacatgggaaaagtgagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggccagagtatcacaaggcgctgggtggagcctgagagaaactgcttgcctaggcaagtcatatgcacaaatgtggcagctgatgtacttccacaggagagacctgagactggcggctaatgccatctgttcagccgttccagttaattgggtcccaaccagccgcaccacttggtcgatccatgcccaccatcaatggatgacaacagaagatatgttatcagtgtggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattattcagactacatgacatcaatgaagagattcaagaatgagagtgatcccgaaggagccctctggtaa

SEQ ID NO: 5315 - RNA, 9879 nt, synthetic construct
  misc_feature 1..9879: note = derived and/or modified CDS sequence (wt) from DENV-1__KX380796__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggagacagatgcaaaaagtggagacttgggccttgagacacccaggattcacggtgatagccctttttctagcacatgccataggaacatccattacccagaaagggatcatcttcattttgctgatgctggtgacaccatcaatggccatgcggtgcgtgggaataggcaacagagacttcgttgaaggactgtcaggagcaacatgggtggatgtggtactggagcatggaagctgtgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagacagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgttggtcacattcaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactctaaaaggggtgtcatatgtgatgtgcacaggctcatttaagctagagaaggaagtggctgagacccagcatggaactgtcctagtgcaggttaaatatgaaggaacagatgcaccatgcaagattccattttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcaacggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtacacacttggacagagcaatataaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaataccaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggttaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtattttacacaaacagcagggccatggcacctaggcaagttggaactagactttgatttgtgtgaaggcaccacagttgttgtggatgaacattgtggaaatcgaggtccatctcttagaaccacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttctcataatgggacaactgacatggaatgatctgatcaggttatgcatcatggttggagccaatgtctcagacagaatggggatgggaacaacgtacctagccttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagccacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgctgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtgggagtgggagtttttcaagacggcgtgttccacacaatgtggcatgtcaccaggggggctgtcctcatgtaccaagggaagaggctggaaccaagttgggccagtgtaaaaaaagacttgatctcatatggaggaggttggaggtttcaaggatcatggaacacgggagaagaagtacaggtgatagctgttgaaccaggaaaaaacccaaagaatgtacagacaacgccgggcaccttcaagacccctgaaggcgaagtcggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagttgacctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaacgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggaccacgctcactggacagaagcaaaaatgctccttgataatataaatacgccagaagggattatcccagccctctttgagccagagagagaaaagagtgcagcaatagacggggagtatagactgcgaggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttggatgccagaacctactctgatccactggccctgcgcgagtttaaagagttcgcagcaggaagaagaagtgtctcaggtgacctaatattagagatagggaaacttccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctgctttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggtttgttattcatgatattgacagtggcagccaacgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcagcggtgttgatgttagtggctcattatgccataatcggacctggactgcaagcaaaagctactagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgcgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacaaggaaaatgtgccacgtgtgtctacaatatgatggggaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagcggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggccacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggaaatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaatccatggatggaggacaaaactcatgtatccagctgggaagatgttccatacttagggaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgatcccgaaggagccctctggtaa

SEQ ID NO: 5316 - RNA, 9879 nt, synthetic construct
  misc_feature 1..9879: note = derived and/or modified CDS sequence (wt) from DENV-1__KX380799__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggagcaggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacttggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggccgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaacgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgacagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcctcagcctggaccctctatgcagtagccacaacaattatcactcccatgatgagacacacaattgaaaacacaacggcaaacatttccctgacagctattgcaaatcaggcggccatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggaaatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 5317 - RNA, 9879 nt, synthetic construct
  misc_feature 1..9879: note = derived and/or modified CDS sequence (wt) from DENV-1__KX380800__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggagcaggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaacgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggaaatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 5318 - RNA, 9879 nt, synthetic construct
  misc_feature 1..9879: note = derived and/or modified CDS sequence (wt) from DENV-1__KX380802__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatgggtaaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggagcaggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaacgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggatttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggaaatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 5319 - RNA, 9879 nt, synthetic construct
  misc_feature 1..9879: note = derived and/or modified CDS sequence (wt) from DENV-1__KX380797__SS-prME
  source 1..9879: mol_type = other RNA
tctgtgaccgtgctcctcatgctgctgcccacagccctagcgtttcatctgaccactcggggaggagagccgcacatgatagttagtaagcaggaaagaggaaaatcacttttgtttaagacctctacaggtgtcaacatgtgtacccttattgcaatggatttgggagagttatgtgaggacacaatgacctacaaatgccccaggatcactgagacggagccagatgacgttgactgttggtgcaatgccacggagacatgggtgacctatggaacatgttctcaaactggtgaacaccgacgagacaaacgttccgtcgcattggcaccacacgtagggcttggcctagaaacaagaaccgaaacgtggatgtcctctgaaggtgcttggagacaaatacaaaaagtggagacttgggctctgagacacccaggattcacggtgatagccctttttctagcacatgctataggaacatccatcacccagaaagggattatttttattttgttgatgctggtaactccatccatggccatgcggtgcgtgggaataggcaacagagacttcgtggaaggactgtcgggagctacgtgggtggatgtagtgctggagcatggaagttgcgtcactaccatggcaaaagacaaaccaacactggacattgaactcctgaagacggaggtcacaaaccctgcagtcctgcgcaaactgtgcattgaagctaaaatatcaaataccaccaccgattcgagatgtccaacacaaggagaagccacgctggtggaagagcaggacacgaacttcgtgtgccgacgaacgctcgtggacagaggctggggcaatggttgtgggctatttggaaaaggtagtttaataacgtgtgctaagtttaagtgtgtgacaaaactggaaggaaagatagtccaatatgaaaacttaaaatattcagtcatagtcaccgtacacactggagaccaacaccaagttggaaatgagaccacagaacatggaacaactgcaaccataacacctcaagctcctacgtcggaaatacagctgacagactacggagctctaacactggattgttcacctagaacaggactagactttaatgagatggtgttgttgacgatgaaagaaaaatcatggctcgtccacaaacaatggtttctggacctaccactgccttggacctcaggggcctcaacatcccaagagacttggaatagacaagacctgctggtcacattcaagacagctcatgcaaaaaagcaggaagtagtcgtgctaggatcacaagaaggagcaatgcacactgcgctgactggagcgacagaaatccaaacgtctggaacgacaacaatttttgcagggcacctaaaatgcagactaaaaatggataaactgaccttaaaaggggtatcatatgtaatgtgcacagggtcatttaagctagagaaggaagtggctgagacccagcatggaactgttctagtgcaagttaaatacgaaggaacagatgcaccatgcaagatccccttcacgtcccaagatgagaagggagtaacccagaatgggagattgataacagccaaccccatagtcactgacaaagaaaaaccagtcaacattgaagcggagccaccttttggggagagctaccttgtggtaggagcaggtgaaaaagctttgaaactaagctggttcaagaagggaagcagtatagggaaaatgtttgaagcaactgcccgcggagcacgaaggatggccatcctgggagacaccgcatgggacttcggttctataggaggggtgttcacatctgtgggaaaactgatacaccagatttttgggactgcgtatggagttttgttcagcggggtttcttggaccatgaaaataggaatagggattctgctgacatggctaggattaaattcaaggagcacatccctttcaatgacgtgtatcgcagtcggcatggtcacactgtacctaggagtcatggttcaggcggactcgggatgtgtaatcaactggaaaggcagagaactcaaatgtggaagcggcatttttgtcaccaatgaggtccacacctggacagagcaatacaaattccaggccgactcccccaagagactatcagcggccattgggaaggcatgggaggagggtgtgtgtgggatccgatcagccactcgtctcgagaacattatgtggaagcaaatatcaaatgaattaaaccacatcttacttgagaatgacatgaaatttacagtggtcgtaggagacgttaatggaatcttggcccaaggaaagaaaatgattaggccgcaacccatggaacacaaatactcgtggaaaagctggggaaaagccaaagtcataggagcagatgtacagaatagcaccttcatcatcgacggcccaaacaccccagaatgccctgatgatcaaagagcatggaatatttgggaagtcgaagactatggatttggaattttcacgacaaacatatggttgaaattgcgtgactcctacactcaagtgtgtgaccaccggctaatgtcagctgccatcaaggatagcaaagcagtccatgctgacatggggtactggatagagagtgaaaagaacgagacttggaagttgacaagagcctccttcatagaagttaagacatgcgtctggccaaaatcccacaccctatggagcaatggagtcttggaaagtgagatgataatcccaaagatatatggaggaccaatatctcagcacaactacagaccaggatatttcacacaaacagcaggaccgtggcacttgggcaagctagaactggattttggtttatgtgaaggtaccactgttgttgtggatgaacattgtggaaaccgaggaccatctcttagaaccacaacagtcacagggaagataatccatgaatggtgctgtagatcttgcacgttaccccccttacgtttcaaaggagaagacgggtgctggtacggcatggaaatcagaccagtcaaggagaaggaagagaacctagtcaagtcaatggtctctgcagggtcaggagaagtggacagtttttcactaggactgctatgcatatcaataatgatcgaagaggtaatgagatccagatggagcaggaaaatgctgatgactggaacactggctgtgttcctccttcttataatgggacagttgacatggaatgatctgatcagactgtgcatcatggttggagctaatgcttcagacaagatggggatgggaacgacgtacctagctttgatggccactttcagaatgagaccaatgttcgcagtcgggctactgtttcgcagattaacatccagagaagttcttcttagatcagttggattgagtctagtggcatctgtagaactaccaaattccttggaggagctaggggatggacttgcaatgggcattatgatgttgaaattactgactgattttcagtcacatcagctatgggctgccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttattacagaaaacaaaatctggggaagaaaaagctggcctctcaatgagggaattatggctgttggaatagttagcattcttctaagttcacttcttaaaaatgatgtaccactagctggcccactaatagctggaggcatgctgatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaagatgaagagagagatgacacacttactattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggtatttatagaattctccaaagaggactgttgggcaagtctcaagtaggggtaggagtttttcaagaaggtgtgttccacacaatgtggcacgtcaccaggggagctgtcctcatgtaccaagggaagagattggaaccaagttgggccagtgttaaaaaagacttgatctcatatggaggaggttggaggtttcaaggatcctggaacacgggagaagaagtgcaggtgattgctgttgaaccgggaaagaaccctaaaaatgtacagacagccccgggtacttttaaaacccctgaaggcgaagttggagccatagctctagactttaaacccggcacatctggatctcctattgtgaacagagagggaaaaatagtaggtctttatggaaatggagtggtgacaacaagtggaacctacgtcagtgccatagctcaagccaaagcatcacaagaaggacctctaccagagattgaggacgaggtgtttaggaaaagaaacctgacaataatggacctacatccaggatcgggaaaaacaagaagataccttccagccatagtccgtgaggctataaaaagaaaactacgcacgctagtcttagctcccacaagagttgtcgcctctgaaatggcagaggcactcaagggaatgccaataaggtaccagacaacagcagtgaaaagtgaacacacgggaaaggagatagttgacctcatgtgtcacgccacttttaccatgcgtctcctctcccctgtgagagttcccaattataatatgattatcatggatgaagcacatttcactgatccagccagcatagcagccagagggtatatctcaacccgagtgggtatgggtgaagcagctgcaattttcatgacggccactccccccggatcgatggaggcctttccacagagcaatgcagctatccaagatgaggaaagagatattcctgaaaggtcttggaactcaggctatgactggattactgatttcccaggaaaaacagtttggtttgttccaagcatcaaatcaggaaatgacattgccaactgtttgagaaagaatgggaaacgggtggtccaattaagcagaaaaacctttgacactgagtaccagaagacaaaaaacaacgactgggactatgttgtcacaacagacatatccgaaatgggagcaaacttccgagctgacagggtaatagacccaaggcggtgcctaaaaccggtaatactaaaagatggcccagagcgtgtcattctagccggaccgatgccagtgactgtggctagcgctgcccagaggagaggaagaattggaaggaaccaaaataaggaaggtgatcagtatatttacatgggacagcctctgaacaatgatgaggaccatgcccattggacagaagcaaaaatgctccttgacaacataaacacaccagaagggattatcccagccctctttgagccggagagagaaaagagcgcagcaatagacggggaatacagactacggggtgaagcgaggaaaaccttcgtggagcttatgagaagaggagatctacctgtctggctatcctacaaagttgcctcagaaggcttccagtactctgacagaaggtggtgctttgatggagaaaggaacaaccaggtgctggaggagaacatggatgtggagatctggacaaaagaaggagaaagaaagaaactacgaccccgctggctggacgccagaacatactctgacccactggctctgcgcgaattcaaagagttcgcagcaggaagaagaagcgtctcaggtgacctaatattagaaatagggaaacttccacaacatctaacgcaaagggcccagaatgccttggacaacctggttatgctgcacaactctgaacaaggaggaaaagcctatagacacgccatggaagaactaccagacactatagaaacgttaatgcttctggctttgatagctgtgttgactggtggggtgacgttgttcttcctatcaggaaggggtctaggaaaaacatccattggtctactctgcgtgatggcctcaagtgcactgttgtggatggccagtgtggaaccccattggatagcggcctctatcatactggagttctttctgatggtgttgcttattccagaaccggacagacagcgcactccacaagacaaccagctagcatacgtggtgataggtctattattcatgatattgacagtggcagccaatgagatgggattactggaaaccacaaagaaggacctagggattggccatgtagctgctgaaagccaccatcatgctgcaatgctggacgtagacctacatccagcttcagcctggaccctttatgcagtggccacaacaattatcactcccatgatgagacacacaattgaaaacacaacggcaaacatctccctgacagctattgcaaaccaggcagctatattgatgggacttgacaagggatggccaatatcaaagatggatataggagttccccttcttgccttggggtgctattctcaggtgaacccgctgacgctgacagcggcggtgttgatgttagtggctcattatgccataattggacccggactgcaagcaaaagctactagagaagctcaaaaaaggacagcagctggaataatgaaaaacccaactgtcgatgggatcgtcgcaatagatttggaccctgtggtttacgatgcaaaatttgaaaaacagctaggccaaataatgctgttgatactttgcacatcacagattctcctgatgcggaccacatgggctttgtgtgaatccatcacactagccactggacctctgaccacactctgggagggatctccaggaaaattctggaacaccacgatagcagtgtccatggcaaacatctttaggggaagctatctagcaggagcaggtctggccttctcattaatgaaatctctaggaggaggtaggagaggcacgggagcccaaggggaaacattgggagaaaaatggaaaagacagctgaaccaattgactaagtcagaattcaacacttacaaaaggagtgggatcatagaggtggatagatctgaagccaaagaggggttaaaaagaggagaaacgactaaacacgcggtgtcgagaggaacggccaaactgaggtggtttgtagagaggaaccttgtgaaaccagaagggaaagtcatagacctcggttgtggaagaggtggctggtcatattattgcgctgggctgaagaaagtcacagaagtgaaaggatacacgaaaggaggacctgggcatgaggaaccaattccaatggcaacctatggatggaacctagtaaaactatactccgggaaagatgtattctttacaccacctgagaaatgtgacaccctcttgtgcgatattggtgagtcctctccgaacccaaccatagaagaaggaagaacgttacgtgtcctaaagatggtggaaccatggcttagaggaaaccaattttgcataaaagttctaaatccctacatgccgagcgtggtagaaactttggagcaaatgcaaagaaaacatggaggaatgctagtgcgaaatccactctcaagaaactccactcatgaaatgtactgggtttcatgtggaacaggaaatattgtgtcagcagtaaacatgacatctagaatgctgctgaatcgattcacaatggctcacaggaaaccaacatatgaaagagacgtggacttaggcgctggaacaagacatgtggcagtagaaccagaggtggccaacctagatatcattggccagaggatagaaaatataaaaaatgaacacaaatcaacatggcattatgatgaggataatccatacaaaacatgggcctatcatggatcatatgaagtcaagccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacgcgcacaccaaaagcgaagcgaggcacagcacaaattatggaggtgacagctaggtggttatgggggtttctttctagaaacaaaaaacctagaatctgtacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaagtgtgccacgtgtgtctacaacatgatgggaaagagagagaaaaaattaggagagtttggaaaggcaaaaggaagtcgcgcaatatggtacatgtggttgggagcgcgctttttagagtttgaagcccttggtttcatgaatgaagatcattggttcagcagagagaattcactcagtggagtggagggagagggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatcttcaagctaacctaccaaaacaaggtagtaagggtgcagagaccagcaaaaaatggaaccgtgatggatgtcatatccaggcgtgaccagagaggaagtggacaggttggaacctatggcttaaacaccttcaccaacatggaggcccaactaataagacaaatggagtctgagggaatctttttacccagcgaattggaaaccccaaatctagctgaaagagtccttgactggttggaaaaatatggcatcgagaggctgaaaagaatggcaatcagtggagatgactgtgtggtgaaaccagttgatgacagattcgcaacagccttaacagctttaaatgacatgggaaaggtaagaaaagacataccacaatgggaaccctcaaaaggatggaatgattggcaacaagtgcccttctgttcacaccatttccaccagctgattatgaaggacgggagggagatagtggtgccatgccgcaaccaagatgaacttgtgggtagggctagagtatcacaaggcgccggatggagcctgagagaaactgcatgcctaggcaagtcatatgcacaaatgtggcagctgatgtacttccacaggagagacttgagactagcggctaatgctatctgttcagccgtcccggttgattgggtcccaaccagccgcaccacttggtcgatccatgcccaccaccaatggatgacaacagaagacatgttgtcagtgtggaatagggtttggatagaggaaaacccatggatggaagacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaactatctagactacatgacatcaatgaagagattcaaaaacgagagtgatcccgaaggggcactctggtga

SEQ ID NO: 5320 - RNA, 9879 nt, synthetic construct
  misc_feature 1..9879: note = derived and/or modified CDS sequence (wt) from DENV-1__KX380805__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggagcaggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactaagcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaacgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggaaatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 5321 - RNA, 9879 nt, synthetic construct
  misc_feature 1..9879: note = derived and/or modified CDS sequence (wt) from DENV-1__KX380798__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaagcagatacaaagagtggagacttgggccctgagacacccaggattcacggtgatagccctttttttagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtgctggaacatggaagttgtgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcacggaaccgttctagtgcagattaaatatgaaggaacagatgcaccatgcaagatccccttttcaacccaagatgaaaaaggagtaacccagaatgggagattgataacagctaaccctatagttactgacaaagaaaaaccagtcaacattgaggcagaaccgccttttggtgagagttacatcgtgataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcagattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcatggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgactcctatacccaagtgtgtgaccaccggctaatgtcagctgccatcaaggacagcaaggcagttcacgctgacatggggtactggatagaaagtgaaaagaatgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacatacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcacaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctaaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgacccatccagtatagcagccagagggtacatctcaacccgagtgggcatgggtgaagcagctgcaatcttcatgacagccacccccccaggatccgtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccagagagagaaaagagtgcagcaatagacggggaatacagactgcgaggtgaggcaagaaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacgaagaaagacttagggattggccatgtggctgttggaaatcaccaccacgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaattgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacagggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5322 - RNA, 9879 nt, synthetic construct
  misc_feature 1..9879: note = derived and/or modified CDS sequence (wt) from DENV-1__KJ649286__SS-prME
  source 1..9879: mol_type = other RNA
tccgtgaccatgctccttatgctgctgcccacagtcttggcgtttcatctgaccacacgagggggagagccgcatatgatagtcaccaagcaggaaagaggaaagtcacttttgttcaagacctcaactggcgtcaacatgtgcacccttattgcgatggacttgggagagttatgtgaggacacaatgacttacaaatgtcctcgaatcactgaggcggaaccagatgacattgattgttggtgcaatgccacagacacatgggtgacctatggaacgtgttcccaaactggcgagcaccgacgagacaaacgttccgtcgcactggctccacacgtgggacttggtctagaaacaagaaccgaaacgtggatgtcctctgaaggcgcttggaaacaaatacaaagagtggagacgtgggccctgagacacccaggattcacagtgacagccctttttctagcacatgccataggaacatccatcacccagaaagggattattttcattttgttgatgctggtaacaccatccatggccatgcgatgtgtgggaataggcaacagggactttgtggaaggactgtcgggagcaacgtgggtagatgtggtactggaacatggaagctgtgtcaccaccatggcaaaagataaaccaacattggacattgaacttttgaagacggaagtcacaaaccctgccgtcctgcgcaaactgtgcattgaagccaaaatatcaaacaccaccaccgattcaagatgtccaacacaaggagaagccacactggtggaagaacaagacgcgaattttgtgtgtcgacgaacgtttgtggacagaggttggggcaatggctgtgggcttttcgggaaaggtagcctaataacgtgtgctaagtttaagtgtgtgactaaattggaaggaaagatagtccaatatgaaaacctgaaatattcagtaatagtcaccgtccacactggagaccagcaccaggtgggaaatgaaagcacagaacatgggacaacagcaaccataacacctcaagctcccacgtcggaaatacagctgaccgactacggagctctcacattggactgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtggtcgtgctgggatcacaagaaggagcaatgcacactgcgttgaccggagcgacagaaatccaaacgtctgggacgacaacgatttttgcaggacacttgaaatgtagactaaaaatggacaaactgactctaaaagggatgtcatatgtgatgtgcacaggctcattcaagctagagaaagaggtggttgagacccagcatggaaccgttctagtgcaggttaaatacgaaggaacagatgcaccatgcaagatcccttttttgacccaagatgaaaaaggagtaacccagaatgggagagtgataacagccaaccctatagtcactgacaaggaaaaaccagtcaacattgaagcagaaccaccttttggtgagagttacatcgtggtaggagcaggtgaaaaagctttgaaactaagctggttcaagaaaggaagcaccatagggaaaatgtttgaggcaactgcccgaggagcacgaaggatggccatactgggagacaccgcatgggactttggttccattggaggagtgttcacatctgttggaaaactagtacaccagatttttggaactgcatatggagttttgtttagcggtgtttcctggaccatgaaaataggaataggggttctgctgacatggctaggattaaactcaaggagcacgtccctttcgatgacgtgcattgcagttggcctggtaacactgtacttaggagtcatggtacaggcggactcgggatgtgtgatcaattggaaaggcagagaactcaaatgtggaagtggcatttttgtcaccaatgaagttcacacttggacagagcaatacaaatttcaggctgactccccaaaaagactatccgcagccatcgggaaggcatgggaggagggtgtgtgtggaattcgatcagccactcgtctcgagaacatcatgtggaagcaaatatcaaatgaactgaaccacatcttacttgaaaatgacatgaaattcacagtggtcgtaggagatgttagtgggatcttggcccaagggaaaaaaatgattaggccacagcccatggaacacaaatactcgtggaaaagctggggaaaagctaaaatcataggggcagatgtacagaactccaccttcatcattgacggcccaaacaccccagaatgccctgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcttccttcatagaagttaaaacatgcgtttggccaaaatctcacactctatggagcaatggagttctggaaagcgaaatgataattccaaagatatatggaggaccaatatctcagcacaactacagaccaggatacttcacacaaacggcagggccgtggcacttaggcaagttggaactagattttgatttgtgtgagggtactacagttgtagtggatgaacattgtggaaatcgaggaccatctctaagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagttaaatcaatggtctctgcagggtcaggagaagtggacagcttttcactaggactgctatgcatatcaataatgattgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagccctgatggccacttttaaaatgagaccaatgtttgctgtcgggctattgttccgcagactaacatctagagaagttcttctccttacaattggattgagtctagtggcatccgtggagctaccaaattccttggaagagctgggggatggacttgcaatgggcattatgatcttaaaattattgactgactttcagtcacatcagctgtgggctgccttgctgtccctgacattcatcaaaacaacttgttctttgcactatgcatggaagacaatggctatggtactgtcaattgtgtctctcttccccttatgcatgtccacgacctctcaaaaaacaacatggcttccggtgctattgggatctcttggatgcaaaccactaactatgtttctcatagcagaaaacaaaatctggggaaggaaaagttggcctctcaatgaaggaatcatggctgtcggaatagtcagcatcttactaagttcactcctcaagaatgatgtgccgctagctgggccactagtagctggaggcatgctaatagcatgctatgttatatctggaagttcagctgatttatcactagagaaagcggctgaggtctcctgggaagaagaagcagaacactccggtgcctcacacaatatattagtggaggtccaagatgatggaaccatgaagataaaagatgaagagagagatgacacactaaccattctccttaaagcaactctgctggcagtttcaggggtgtacccattgtcaataccagcgaccctttttgtgtggtatttttggcagaaaaagaaacagagatcaggagtgttatgggacacacctagccctccagaagtggaaagagcggttcttgatgatggtatctatagaattatgcagagaggactgttgggcagatcccaagtaggggtaggagtttttcaagaaaacgtgttccacacaatgtggcacgtcaccaggggagctgtactcatgtataaagggaagagactggaaccgacttgggctagtgtcaaaaaagacctgatctcatatggaggaggttggaggcttcaaggatcctggaacacgggagaagaagtgcaggtgattgctgttgaaccggggaaaaaccccaaaaatgtacagacagcgccgggcaccttcaagacccctgaaggtgaagtcggagccatagccctagattttaaacccggcacatctggatcccccattgtgaacagagaggggaaaatagtaggtctttatggaaatggagtagtgacaacaagtggaacctacgtcagtgccatagctcaagctaaagcatcacaagaagggcccctaccagagattgaggacgaagtgtttaggaaaagaaacttaacaataatggacctacatccaggatcgggaaaaacaagaagataccttccagccatagtccgtgaggccataaaaaggaagctgcgcacactaattttggctcccacaagagttgtcgcttccgaaatggcagaggcgctcaagggaatgccaataaggtatcagacaacagcagtgaagagtgaacacacaggaaaggagatagttgacctcatgtgccacgccactttcactatgcgtcttctgtctcccgtgagagttcccaactacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgactggatcactgacttcccaggtaaaacagtctggtttgttccaagcattaaatcgggaaatgacattgccaactgtttaagaaagaatgggaaacgggtgattcaattgagtaggaaaacctttgacactgagtaccaaaagacaaaaaacaacgactgggactatgtcgtcacaacagacatctccgaaatgggagctaacttcagagccgacagggtaatagacccaagacggtgtctgaaaccggtaatactaaaagatggtccagagcgtgtcattctagcaggaccgatgccagtgactgtggccagtgctgcccagaggagaggaagaatcggaaggaaccaaaataaggaaggtgatcagtacatctacatgggacagcctttaaacaacgatgaagaccacgctcattggacagaagcaaaaatgctccttgataatataaacactccagaagggattatcccagccctctttgaaccggagagagaaaagagtgcggcaatagacggggaatatagactgcggggtgaagcaaggaaaacatttgtggagctcatgagaagaggagatctacctgtctggctatcctacaaagttgcctcagaaggcttccagtactctgacagaagatggtgctttgatggggaaaggaacaatcaggtgttggaggagaacatggacgtagagatctggacaaaagaaggagaaagaaagaaactacgaccccgctggcttgatgccagaacatactcagacccattggccctgcgcgagtttaaagagtttgcagcaggaagaagaagcgtctcaggtgatctaatattagaaataggaaaacttccacagcacctgacgcaaagggcccagagtgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaagggcttagggaaaacatccatcggcctactttgcgtgatggcttcaagcatgctattatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgctggacgtagacttacatccagcttcagcctggaccctttatgcagtggccacaacaattattactcccatgatgaggcacacaatcgaaaacacaacggcaaacatttccctgacagctattgcaaaccaggcagccatattgatgggactcgacaaaggatggccaatatcgaagatggacataggagttccacttctcgccttggggtgctactcccaggtgaacccaatgacgctgacagcggcagtattgatgctagtggctcattacaccataattggacctggactgcaagcaaaagctacaagagaagcccaaaaaaggacagcggccggaataatgaagaatccaactgtcgatggaatagttgcaatagatttggaccctgtggtttatgatgcaaaatttgagaaacaactaggccaaataatgttgttgatactgtgcacatcacagatcctcttgatgcggactacatgggccctgtgtgaatccatcacactggctactggacctctgaccacgctttgggagggatctccaggaaaattttggaacaccacgatagccgtgtccatggcaaacatattcagaggaagttatctagcaggagcaggcctggccttctcactaatgaaatctctaggaggaggtaggagaggtacgggagcccaaggggaaacattgggagaaaaatggaaaagacagctaaaccaactgagcaagtcagaattcaacacttacaaaaggagtgggatcatagaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagaccttggttgtggaagaggtggctggtcatattattgcgccgggctgaagaaagtcacagaagtgaagggatacacaaaaggaggagctggacatgaggaaccaatcccaatggcgacctatggatggaacctagtaaagctacactccgggaaagacgtattctttataccacctgaaaaatgtgacacccttttgtgtgacattggtgagtcctctccgaacccaaccatagaagaaggaagaacgttacgtgtcctaaagatggtggaaccatggctccgaggaaaccaattttgcataaagattctaaacccctacatgccaagtgtggtggaaactctggagcagatgcaaagaaaacatggaggaatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacttaggagctggaacaagacatgtggcagtggaaccagaggtagctaacctagatatcattggccagaggatagagaacataaaacatgaacacaagtcaacatggcattatgatgaggacaatccatacaagacatgggcttatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcgaaacgaggcacagcacaagtcatggaggtgacagctaggtggctatggggttttctttctagaaacaaaaaaccaagaatctgcacaagagaggagttcacaagaaaagttaggtcaaacgcagccattggagcagtgttcgttgatgaaaatcaatggaactctgcaaaagaagcagtggaagatgagcggttctgggaccttgtgcacagagagagggagcttcacaaacagggaaaatgtgccacatgtgtttacaatatgatggggaaaagagagaaaaaactaggagagtttggaaaggcaaaaggaagtcgtgcaatatggtacatgtggttaggagcacgctttctagagtttgaagcccttggtttcatgaacgaagatcactggttcagtagagagaattcactcagtggagtggaaggagaaggactccacagactcggatacatacttagagacatatcaaagattccagggggaaacatgtatgcagatgacacagccggatgggatacaaggataacagaggatgatcttcagaatgaagccaagatcactgacatcatggagcccgaacatgccctgctagctacgtcaatcttcaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggactcttttcacccagcgaactagagaccccaaacttggccgagagagttctcaactggttgggaaaatatggcgtcgaaaggctgaaaagaatggcaatcagcggagatgactgcgttgtgaaaccaattgacgacaggttcgcaacagccctaacagctctaaacgatatggggaaagtgaggaaagacataccacaatgggaaccttcaaaaggatggaatgactggcaacaagtgcctttttgttcacaccatttccaccagctgattatgaaggatgggagggaaatagtggtgccatgccgcaaccaagatgaacttgtgggtagggctagagtgtcacaaggtgccggatggagcctgagagaaactgcatgcctaggcaagtcatatgcacaaatgtggcagctgatgtacttccacaggagagacctgagactagctgctaatgccatctgttcagccgttccagttgattgggtcccaaccagccgcaccacttggtcgatccatgcccatcatcaatggatgacaacagaaaacatgttgtcagtgtggaatagggtttggatagaggaaaacccatggatggaggacaaaacccatgtgtccagttgggaagatgttccatatttagggaaaagggaagatcagtggtgtggttccctgataggcttaacagcaagggccacctgggccactaacatacaagtggctataaaccaagtgagaaagctaattgggaatgagaattacctagattatatgacatcaatgaagagattcaagaacgatagcgatcccgaaggggcactctggtga

SEQ ID NO: 5323 - RNA, 9879 nt, synthetic construct
  misc_feature 1..9879: note = derived and/or modified CDS sequence (wt) from DENV-1__KF887994__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaacttttgaagacggaagtcacaaaccctgccatcctgcgcaaactgtgcattgaagctaaaatatcaaacaccaccaccgactcaagatgcccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgcttgaggcaactgccagaggagctcgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgacatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaactgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagtaatggagttctggaaagtgaaatgataattccaaagatctatggaggaccaatatctcagcacaactacagaccaggatatttcacacaaacagcagggccgtggcacctgggcaagttggaactggattttgatttgtgtgagggcaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataataggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctaatggcatctgtggagttaccaaattccttggaggagctgggggatggacttgcaatgggcattatgattttaaaattactgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaagaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtatccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattttggctcccacaagggttgtcgcttccgaaatggcagaggcgctcaagggaatgccaataaggtaccaaacaacagcagtaaagagtgaacacacaggaaaagagatagttgatctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagcagacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcttagggaaaacatctattggcctactctgcgtaatggcttcaagcgtactgctatggatggccagtgtagagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaagtgaatccactgacgctgacagcggcggtattgatgctagtggctcattacgccataattggacctggactgcaagcaaaagctactagagaagctcaaaaaaggacagcggccgggataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagcaaaagagggattgaaaagaggagaaacaaccaaacatgcagtgtcgagaggaaccgctaaactgagatggtttgtggagaggaaccttgtcaaaccagaagggaaagtcatagacctcggctgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctccccaaacccaactatagaggaaggaagaacgctacgcgtcctaaagatggtggaaccatggctcagaggaaaccaattttgcataaagattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggtattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcattcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcgtatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgcctggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttaattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaaaactaattgggaatgagaattacctagattacatgacatcaatgaagagattcaagaacgagagtgatcccgaaggggcactctggtga

SEQ ID NO: 5324 - RNA, 9879 nt, synthetic construct
  misc_feature 1..9879: note = derived and/or modified CDS sequence (wt) from DENV-1__JQ675358__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgctggtgtcaatatgtgcactctcattgcgatggacttgggagagttatgtgaggacacaatgacctacaaatgcccccagatcactgaggcggaaccagatgatgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattctgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagatgcgaactttgtgtgtcgccgaacgtttgtggacagaggctggggcaatggctgtggactattcggaaagggaagcctattgacgtgtgccaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcccacgtcggaaatacagctgaccgactacggagccctcacattggactgctcacctagaacagggctggattttaatgagatggtgctattgacaatgaaagaaagatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggcttatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagtcttggaaagtgaaatgataatcccaaagacatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttctcattaggaatactatgcgcatcaataatgattgaagaagtgatgagatccagatggagtagaaagatgctgatgactggaacactggctgttttcctccttcttataatgggacaactgacatggaatgatctgattaggttatgtatcatggttggagctaatgcttcagacaggatggggatgggaacaacgtacctagccttgatggctactttcaaaatgagaccaatgtttgctgttgggctattatttcgcagactaacatccagagaagttcttcttctcacgattggattaagcttggtggcatccgtggagctaccaaattctttagaggagctaggggatggacttgcaatgggtatcatgatgttgaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaattatggctattggaatagttagccttctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactcgttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaagaaaaaaccccaaaaatgtacagacaacgccgggtaccttcaagactcctgaaggtgaagttggagccatagctctagattttaaacccggcacatctggatcccccatcgtgaatagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggctagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaagaaacaaccaggtgttggaggagaacatggacgtggagatctggacaaaggaaggagaaagaaagaaattacgaccccgctggttggacgccagaacatactctgatccgttggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgtactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacattggctactggacccctgaccactctctgggagggatctccaggaaaattctggaataccacgatagcagtgtccatggcaaacatcttcaggggaagttatctagcaggagcaggtctggctttttcattaatgaaatctgtaggaggaggtaggagaggtatgggagctcaaggggaaacactgggagagaaatggaaaagacagttaaaccaactgagtaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcagggtcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatttgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtttacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttacatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagctctgaatgacatgggaaaagtaagaaaagacataccgcagtgggaaccttcaaaaggatggaatgattggcagcaagtgcctttctgttcacaccatttccaccagctaatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagtcccatacctagggaaaagggaagatcaatggtgtggatccttgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5325 - RNA, 9879 nt, synthetic construct
  misc_feature 1..9879: note = derived and/or modified CDS sequence (wt) from DENV-1__FJ850070__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcggtcagccacgcgtcttgagaacatcatgtggaagcaaatatcaaatgaattgaactacatcctacttgaaaatgacatgaaattcacagtggttgtaggagacgctaatggaattttggcccaaggaaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatttgggaagttgaggactatgggttcggaattttcacgacaaacatatggctgaaattgcgtgactcccacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacgattggattaagcctggtggcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggtatgctaatagcatgttatgtcatatccggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagcctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcatcacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggagagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgctggaaaccacaaagaaagacctagggattggccatgtagccgccgaaaaccaccaccatgccacaatgctggacgtagacctacatccagcttcagcctggaccctctatgcagtagccacaacagttatcacccccatgatgagacacacaattgaaaacacaacggcaaatatttccctgacagccatcgcaaaccaggcagctatattgatggggcttgataagggatggccaatatcgaagatggacataggagttccacttctcgccttagggtgctattcccaagtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagtcatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcactacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5326 - RNA, 9879 nt, synthetic construct
  misc_feature 1..9879: note = derived and/or modified CDS sequence (wt) from DENV-1__FJ850071__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacagtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccactgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactgagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgctaatggaattttggcccaaggaaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatttgggaagttgaggactatgggttcggaattttcacgacaaacatatggctgaaattgcgtgactcccacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaagatgctgatgactggaacactggctgttttcttccttcttataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcaaactaacatccagagaagttcttcttctcacgattggattaagcctggtggcatccgtggagctaccaaattctttagaggagctaggggatggacttgcaatgggcatcatgatgttaaaattattgactgactttcagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatccggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcatcacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatactggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaacacaacggcaaatatttccctgacagccattgcaaaccaggcagctatattgatggggcttgataagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgcacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaaaggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtggccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcactacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5327 - RNA, 9879 nt, synthetic construct
  misc_feature 1..9879: note = derived and/or modified CDS sequence (wt) from DENV-1__FJ850073__SS-prME
  source 1..9879: mol_type = other RNA
tccgtgaccatgctcctcatgctgctgcccacagccctggcattccacttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccattactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgtggattattcggaaaaggaagcctattgacgtgtgccaagtttaagtgtgtgacaaaactagaaggaaagatagttcaatatgaaaacttgaaatattcagtgatagttaccgtccacactggggatcagcaccaggtgggaaacgagaccacagaacatggaacaattgcaaccataacacctcaagctcctacgtcggaaatacagctgactgactacggagctctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcaggacacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatccctttttcgacccaggatgagaaaggagtgacccagaatgggagattgataacagccaatcccatagtcactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagataccgcatgggacttcggttctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctgatggaattttggcccaaggaaaaaaaatgattaggccacaacccatggaacacaaatattcatggaaaagctggggaaaagctaaaatcataggagcagacatacaaaataccaccttcatcatcgacggcccagatactctagaatgccccgatgaacaaagagcgtggaacatttgggaagttgaggactatgggtttggaattttcacgacaaacatatggctgaaattgcgtgactcctacacccaaatgtgtgaccaccggctgatgtcagctgccatcaaggacagcaaggcagtccatgctgacatggggtactggatagaaagcgaaaagaacgaaacctggaagctggcgagagcctcgttcatagaagtcaagacatgcatctggccgaaatcccacactctatggagtaatggagttttggaaagtgaaatgataatcccaaagatgtatggaggaccagtatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggagtactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtactgtcaatcgtatctctctttcctttatgcctgtctacaacctctcaaaaaacaacatggcttccggtgctgttaggatcttttggatgcaaaccattaaccatgtttctcataacagaaaacgaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagtagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggcaccttcaagactcctgaaggcgaagttggagccatagctctagattttaaacccggcacatctggatctcccattgtgaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaaaagtgagcacacaggaagggagatagttgacctcatgtgccacgccacttttaccatgcgtctcttatccccagtgagagttcccaattacaacatgattatcatggatgaagcacattttaccgatccagccagtatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgacggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatggctgtgttgactggtggagtgacgctgttcttcctatcaggaaaaggtctagggaaaacgtccattggcttgctctgtgtgatggcttcaagcgcactgttatggatggccagtgtggagccccattggatagcggcctccatcatactagagttctttttgatggtgctgctcattccagagccagacagacagcgcactccacaggacaaccagctagcatatgtggtgatagggttgttattcatgatactgacagtggcagccaatgagatgggattattggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgcgaatctatcacactggctactggacccctgaccactctttgggagggatctccaggaaaattctggaataccacgatagcagtgtccatggcaaacatcttcaggggaagttatctggcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaaaaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatctagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaagccatgggatgttatccccatggtcacacaaatagctatgactgataccacaccctttggacaacagagagtgttcaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaactcactcagtggagtggaaggagaaggactgcacaaacttggatacatactcagagacatatcaaagattccggggggaaatatgtatgcagatgatacagccggatgggacacaagaataacagaggatgatcttcggaacgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatctttttttccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcccttctgttcacaccatttccaccagctgatcatgaaggatgggagggaaatagtggtgccatgccgcaaccaagacgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgggaattatctagattacatgacatcaatgaagagattcaagaatgagagtgatcccgaaggggcactctggtaa

SEQ ID NO: 5328 - RNA, 9879 nt, synthetic construct
  misc_feature 1..9879: note = derived and/or modified CDS sequence (wt) from DENV-1__FJ850075__SS-prME
  source 1..9879: mol_type = other RNA
tccgtgaccatgctcctcatgctgctgcccacagccctggcgtttcatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacatttaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgctaatggaattttggcccaaggaaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatttgggaagttgaggactatgggttcggaattttcacgacaaacatatggctgaaattgcgtgactcccacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttagaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggatatcgaggtccatctctcagaactacaacagttacaggaaagacaatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacgattggattaagcctggtggcatccgtggagctaccaaattctttagaggagctaggggatggacttgcaatgggcatcatgatgttaaaattattgactgacttccagccacaccagttatggaccaccctattgtctctaacattcatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatccggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcatcacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagctactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacgggaaacgggtgattcaactgagcaggaaaacctttgacactgagtaccagaaaacaaaaaacaatgactgggattacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgagcaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacgacagttatcacccccatgatgagacacacaattgaaaacacaacggcaaatatttccctgacagccatcgcaaaccaggcagctatattgatggggcttgataagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgtcgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcactacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5329 - RNA, 9879 nt, synthetic construct
  misc_feature 1..9879: note = derived and/or modified CDS sequence (wt) from DENV-1__FJ850077__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcaccgaggtggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaagtacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggatgtggtactggagcatggaagctgcgtcaccaccatggcaaaaaacaaaccaacattggacattgaactcttgaaaacggaggtcacgaatcctgccgtcctgcgcaaactgtgcattgaagctaaaatatcaaacaccaccactgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagcccttacattggactgctcacctagaactgggctggactttaatgagatggtgctactgacaatgaaagaaaaatcatggcttgtccacaaacaatggtttctagacttaccactgccttggacttcgggagcttcaacatctcaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacattatgtggaagcaaatatcaaatgaattgaactacatcctacttgaaaatgacatgaaattcacagtggttgtaggagacgctaatggaattttgacccaaggaaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatctgggaagttgaggactatgggttcggaattttcacgacaaacatatggctgaaattgcgtgactcctacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaacatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagccaatgcttcagacaggatggggatggggacaacgtacctagccttgatggccactttcaaaatgagaccaatgtttgctgttgggctattatttcgcaaactaacatccagagaagttcttcttctcacgattggattaagcctggtggcatccgtggagctaccaaattctttagaggagctaggggatggacttgcaatgggcatcatgatgttaaaattattgactgactttcagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacagaatctggggaaggaaaagctggcccatcaatgaaggagttatggctgttggaatagtcagcattctactaagttcactcctcaaaaatgatgtgccgctagccggcccactaatagcaggaggcatgctaatagcatgttatgtcatatccggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtattatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaagatagtaggtctttatggaaatggagtggtgacaacaagtggaacctacgtcagtgccatcgctcaagcgaaagcatcacaagaagggcctctaccagagattgaggacgaggtgttcaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggttcgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggctagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaacacaacggcaaatatttccttgacagccattgcaaaccaggcagctatattgatggggcttgataagggatggccaatatcgaagatggacataggagttccacttctcgccttagggtgctattcccaggtgaacccattgacactgacagcaacggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactagctactggacccttgaccactctctgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaagccagaagggaaagtcatagacctcggttgtgggagaggtggctggtcatattactgcgctgggctgaagaaagtcactgaagtgaaaggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgatttacaatggctcacaggaagccaacatatgaaagagacgtggacttaggcgctggaacaagacatgtggcagtggaaccagaggtggccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcttatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagatatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgactgggtcccaaccagccgtactacctggtcgatccatgcccaccaccaatggatgacaacagaagacatgttatcagtgtggaatagggtttggatagaggaaaacccatggatggaagacaaaactcatgtatccagttgggaagaagttccatacctaggaaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5330 - RNA, 9879 nt, synthetic construct
  misc_feature 1..9879: note = derived and/or modified CDS sequence (wt) from DENV-1__FJ850081__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtgctggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactattcggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcgtatggggttctgttcagtggtgtttcttggaccatgaaaataggaatagggattctgctgacatggttgggattaaactcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgctaatggaattttggcccaaggaaaaaaaatgattagaccacaacccatggaacacaaatactcatggaaaagttggggaaaagccaaaatcataggagcagacatacagaacaccaccttcatcattgacggcccagatactccagaatgccccgatgaccaaagagcatggaacatttgggaagttgaggactatgggttcggaattttcacgacaaacatatggctgaaattgcgtgactcccacacccaaatgtgtgaccaccggctaatgtcggctgccatcaaggacagcaaggcagtccatgctgatatggggtactggatagaaagtgaaaagaacgagacctggaagctagcgagagcctcctttatagaagtcaagacatgcatctggccgaaatcccacaccctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagctaatgcttcagacaggatggggatggggacaacgtacctagccttgatggccactttcaaaatgagaccaatgttcgctgttgggctattatttcgcagactaacatccagagaagttcttcttctcacgattggattaagcctggtggcatccgtggagctaccaaattctttagaggaactaggggacggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaatcatggctgttggaatagtcagcattctactaagttcactcctcaaaaatgatgtgccgctagccggcccactaatagctggaggcatgctaatagcatgttatgtcatatccggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtgggtctttatggaaatggagtggtgacaacaagtggaacctacgtcagtgccatcgctcaagctaaagcatcacaagaagggcctctaccagagattgaggacgaggtgttcaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcggccagagggtacatctcaacccgagtgggtatgggtgaagcagctgcgatcttcatgacagccactcccccaggatcggcggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggattacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggccagtgccgcccagaggagaggaagaattggaaggaaccaaaacaaagaaggtgatcagtacatttacatgggacagcccttaaacaatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaactgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctactcattccagagccagacagacagcgcactccacaggacaaccagttagcatatgtggtgataggtttgctattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaacacaacggcaaatatttccctgacagccatcgcaaaccaggcagctatattgatggggcttgataagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaaaggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttattgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccctatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagagaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaggacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctaagactagcggctaatgccatctgttcagccgtcccagttgattgggtcccaaccagccgcactacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5331 - RNA, 9879 nt, synthetic construct
  misc_feature 1..9879: note = derived and/or modified CDS sequence (wt) from DENV-1__FJ850084__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtgggtgtcaacatgtgcactctcattgcgatggatttgggagagttatgtgaggacacaatgacctataaatgcccccggatcaccgaggtggaaccagatgacgttgactgctggtgtaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaatcctgccgtcctgcgcaaactgtgcattgaagctaaaatatcaaacaccaccactgattcaagatgtccaacacaaggagaagccacactggtggaagaacaagacgcgaactttgtgtgtcgacggacgttcgtggatagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatctcaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccattctgggagacaccgcatgggacttcggctctataggaggattgttcacgtctgtgggaaaattgatacaccaggtttttggagctgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagcggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacattatgtggaagcaaatatcaaatgaattgaactacatcctacttgaaaatgacatgaaattcacagtggttgtaggagacgctaatggaattttgacccaaggaaaaaaaatgattagaccacaacccatggaacacaaatactcatggaaaagttggggaaaagccaaaatcataggagcagacatacagaacaccacctttatcattgacggcccagatactccagaatgccctgatgaccaaagagcatggaatatctgggaagttgaggactatgggttcggaattttcacgacaaacatatggctgaaattgcgtgactcctacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaacatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcagcagaagtggacagtttttcattaggaatactatgcgtatcaatactgattgaagaagtgatgagatccagatggagtagaaagatgctgatgactggaacactggctgttttcctccttcttataatgggacaactgacatggaatgatttgatcaggttatgcatcatggttggagccaatgcttcagacaggatggggatggggacaacgtacctagccttgatggccactttcaaaatgagaccaatgttcgctgttgggctattatttcgcaaactaacatccagagaagttcttcttctcacgattggattaagcctggtggcatccgtggagctaccaaattctttagaggagctaggggatggacttgcaatgggcatcatgatgttaaaattattgactgactttcagccacaccagttatggaccaccctattgtctctaacatttatcagaacatctctttcattggattatgcatggaagacaatggccatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccattaatagctggaggcatgctaatagcatgttatgtcatatccggaagctcagctgatttatcattggaaaaagcggctgaggtgtcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtattatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaagatagtaggtctttatggaaatggagtggtgacaacaagtggaacctacgtcagtgccatcgctcaagcgaaagcatcacaagaagggcctctaccagagattgaggacgaggtgttcaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggttcgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgttattttagccggaccgatgccagtgactgtggctagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagttcaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggcctagggaaaacatccattggcctactctgtgtgatggcctcaagcgcactgttatggatggccagtgtggagccccattggatagcggcctccatcatattagagttctttctgatggtgttgctcattccagagccagacagacagcgcactccacaggacaaccagttagcatatgtggtgataggtttgttattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaacacaacggcaaatatttccttgacagccattgcaaaccaggcagctatattgatggggcttgataagggatggccaatatcgaagatggacataggagttccacttctcgccttagggtgctattcccaggtgaacccattgacactgacagcgacggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactagctactggacccttgaccactctctgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaagtggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaaaggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgatttacaatggctcacaggaagccaacatatgaaagagacgtggacttaggcgctggaacaagacatgtggcagtggaaccagaggtggccaacctagatatcattggccagaggatagaaaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgatactacacccttcggacaacagagggtgtttaaagagaaagttgacacgcgcacaccaagagcaaaaagaggcacagcacaaattatggaggtgacagccaagtggttatggggtttcttatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggtttagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagatatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgactgggtcccaaccagccgtactacctggtcgatccatgcccaccaccaatggatgacaacagaagacatgttatcagtgtggaatagggtttggatagaggaaaacccatggatggaagacaaaactcatgtatccagttgggaagaagttccatacctaggaaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5332 - RNA, 9879 nt, synthetic construct
  misc_feature 1..9879: note = derived and/or modified CDS sequence (wt) from DENV-1__FJ850087__SS-prME
  source 1..9879: mol_type = other RNA
tccgtgaccatgctcctcatgctgctgcccacagccctggcgttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcatcttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaagggaaaaaaatgattagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatcccagcacaactacagaccagggtatttcacacaaacagcagggccatggcacctaggcaagttggaattggattttgacttgtgtgaaggtaccacagttgttgtagatgaacattgtggatatcgaggtccatctctcagaaccacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtaatgagatccagatggagtagaaagatgctgatgactggaacactggttgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggtggcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcctttggatgtaaaccattaaccatgtttctcataacagaaaacaaaatctggggaaggaaaagctggcccatcaatgaaggaattatggctgttggaatagttagcattctactaagttcactcctcaaaaatgatgtgccactagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgacacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggtaggtcccaagtaggagtgggagttctccaagacggcgtgttccacacaatgtggcacgtcaccaggggagctgtccttatgtaccaagggaagaggctggaaccaagctgggccagtgtcaaaaaagacttgatttcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtctaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggacataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggctggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcagcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggttggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcaatgggaaccttcaaaaggatggaatgactggcagcaagtccccttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattacatgacatcaatgaagagattcaagaatgagagtgatcccgaaggggcactctggtaa

SEQ ID NO: 5333 - RNA, 9879 nt, synthetic construct
  misc_feature 1..9879: note = derived and/or modified CDS sequence (wt) from DENV-1__FJ850090__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcctgtttaagacctctgtaggtgtcaacatgtgcactctcattgcgatggatttgggagagttatgtgaggacacaatgacctacaaatgcccccggatcaccgaggtggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaatcctgccgtcctgcgcaaactgtgcattgaagctaaaatatcaaacaccaccactgattcaagatgtccaacacaaggagaagccacactggtggaagaacaagacgcgaactttgtgtgtcgacggacgttcgtggatagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagatttaccactgccttggacttcgggagcttcaacatctcaagagacttggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgatccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggctgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacattatgtggaagcaaatatcaaatgaattgaactacatcctacttgaaaatgacatgaaattcacagtggttgtaggagacgctaatggaattttgacccaagggaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatctgggaagttgaggactatgggttcggaattttcacgacaaacatatggctgaaattgcgtgactcccacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaacatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacttagttaggtcaatggtctctgcagggtcaggagaagtggacagtttttcattaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagccaatgcttcagataggatggggatggggacaacgtacctagccttgatggccactttcaaaatgagaccaatgttcgctgttgggctattatttcgcaaactaacatccagagaagttcttcttctcacgattggattaagcctggtggcatccgtggagctaccaaattctttagaggagctaggggatggacttgcaatgggcatcatgatgttaaaattattgactgactttcagccacaccagttatggaccaccctattgtctctaacatttattagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgttagccggcccactaatagctggaggcatgctaatagcatgttatgtcatatccggaagctcagctgatttatcattggaaaaagcggctgaggtatcctgggaagaagaagcagaacactctggcacctcacacaacatattagtggaggtccaagatgatggaaccatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtattatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaagatagtaggtctttatggaaatggagtggtgacaacaagtggaacctacgttagtgccatcgctcaagcgaaagcatcacaagaagggcctctaccagagattgaggacgaggtgttcaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccactttcaccatgcgtctcttatctccagtgagagttcccaattacaacatgattatcatggatgaagcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggttcgttccaagcatcaaatcaggaaatgacattgctaactgtttaagaaagaacggaaaacgggtgattcaactgagcaggaaaacctttgacactgagtaccaaaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgttattctagccggaccgatgccagtgactgtggctagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctataaagttgcctcagaaggtttccaatactccgacagaagatggtgctttgatggggaaaggaataaccaggtgttggaggagaacatggacgtggagatttggacaaaggagggagaaagaaagaaattgcgaccccgctggttggatgctagaacatactctgacccactggccctgcgcgagtttaaagagtttgcagcaggaagaagaagtgtctcaggtgacctaatattggaaataggaaaactcccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatattgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaacacaacggcaaatatttccttgacagccattgcaaaccaggcagctatattgatggggcttgataagggatggccaatatcgaagatggacataggagttccacttctcgccttagggtgctattcccaggtgaacccattgacactgacagcgacggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactagctactggacccttgaccactctctgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagaggaacctcgtgaaaccagaagggaaagtcatagacctcggttgtgggagaggcggctggtcatattactgcgctgggttgaagaaagtcactgaagtgaaaggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgatttacaatggctcacaggaagccaacatatgaaagagacgtggacttaggcgctggaacaagacatgtggcagtggaaccagaggtggccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatgggatttcttatccagaaacaaaaaacccagaatctgcacaagagaggagttcacaagaaaagttagatcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaagggagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaacactttcaccaatatggaggtccaattaataagacaaatggagtctgaaggaattttctcacccagcgaattggaaacccccaatctagctaagagagttcttgactggttggaaaaacatggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagatatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgactgggtcccaaccagccgtactacctggtcgatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5334 - RNA, 9879 nt, synthetic construct
  misc_feature 1..9879: note = derived and/or modified CDS sequence (wt) from DENV-1__FJ850093__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggattactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacaaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggacaaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgcggaattcgatcagccacgcgtcttgagaacattatgtggaagcaaatatcaaatgaattgaaccacattttacttgaaaatgatatgaaattcacagtggttgtaggagatgctaacggaattttggcccaagggaaaaagatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctcttagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgacaggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgttgggctattattccgcagattaacatccagagaagttcttctcctcacgattggattaagcctgatggcatccatggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatgatactgtctatcgtatctctctttcctttatgcctgtccacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaggcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatttcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttgatcttggctcccacaagagttgttgcctctgaaatggcagaggcactcaagggaatgccaataagatatcagacaacagcagtgaagagtgaaaccacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcaccgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcggcctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccattacactggctactggacccctgaccactctctgggagggatctccgggaaaattctggaataccacgatagcagtgtccatggcaaacatcttcaggggaagttatctagcaggagcaggtctggctttttcattaatgaaatctttaggaggaggtaggagaggtacgggggctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagagagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttattcccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaagcccagaatctgcacaagagaggagttcacaagaaaagttaggtcaaacgcggcaataggagcagtgttcgttgatgaaaaccaatggaactcggcaaaagaagcagtggaagacgaaaggttttgggacctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaatcaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgcgaaggctcatcgggaatgagaattatctagattacatgacatcaatgaagagattcaagaatgagagtgatcctgaaggagcactctggtaa

SEQ ID NO: 5335 - RNA, 9879 nt, synthetic construct
  misc_feature 1..9879: note = derived and/or modified CDS sequence (wt) from DENV-1__GU131863__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaacagaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgtttgaagcaaccgcccgaggagcacgaaggatggccatcctgggagacactgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcaccaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacattaatggaattttggcccaaggaaaaaaaatgatcagaccacaacccatggaacacaaatactcatggaaaagttggggaaaagccaagatcataggagcagacatacagaacaccacctttatcattgacggtccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggtggcatccgtggagctgccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtctggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctactagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggcacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacactacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 5336 - RNA, 9879 nt, synthetic construct
  misc_feature 1..9879: note = derived and/or modified CDS sequence (wt) from DENV-1__GQ868559__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcctgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaagggcatgtcatatgtgatgtgcacaggctcatttaagctagagaaggaagtggctgagacccagcacggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagttacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacattatgtggaagcaaatatcaaatgaattgaaccacattctacttgaaaatgacatgaaattcacagtggttgtaggagatgctaacggaattttggcccaagggaagaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcaggctaacatccagagaagttcttctcctcacgattggattaagcctggtggcatccgtggagctaccaaattctttggaggagctaggggatggacttgcaatgggtatcatgatgttaaaattgttgaccgaatttcagccacaccagttatggaccaccttactgtctctgacatttgtcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcagagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacaccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgctattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgcttcttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactatcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacatgtgtctacaacatgatggggaagagagagaaaaaattgggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagggacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaataaggtagtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5337 - RNA, 9879 nt, synthetic construct
  misc_feature 1..9879: note = derived and/or modified CDS sequence (wt) from DENV-1__GQ868560__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcacggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagttacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattctggcccaagggaagaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcactcaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccaattatggaccaccttactgtctctgacatttgtcaaaacaactctttcattggactatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtatcaaaaaggacttgatctcatatggaggaggttggaggtttcaaggatcatggaacacgggagaagaagtgcaggtgatagctgttgaaccaggaaaaaaccccaaaaatgtacagacaacaccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgaatcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtagtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatatagattacatgacatcaatgaagagattcaagaatgagagtgatcccgaaggagcactctggtaa

SEQ ID NO: 5338 - RNA, 9879 nt, synthetic construct
  misc_feature 1..9879: note = derived and/or modified CDS sequence (wt) from DENV-1__GQ868561__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaacttcgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggattgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaagttgcgtgactcctacacccaaatgtgtgaccaccggctaatgtcagctgccatcaaggacagcaaggcagtccatgctgacatggggtactggatagaaagtgaaaagaacgaaacctggaagctggcgagggcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttctcataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtagctagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaatcaggtgttggaagagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcagccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgagtccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggaattcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaccaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacggcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5339 - RNA, 9879 nt, synthetic construct
  misc_feature 1..9879: note = derived and/or modified CDS sequence (wt) from DENV-1__GU131948__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgctacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccagggttcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagtttaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattaacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacattgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaactgaaccacattctacttgaaaatgacatgaaattcacagtggttgtaggagatgctaacggaattttggcccaagggaaaaaaatgattaggccacaacccatggaacacaaatactcatggaagagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggacgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggaaaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaaattcttctcctcacgattggattaagcctagtggcatccgtggagctaccaaattctttggaggagctaggggatggacttgcaatgggtatcatgatgttaaaattgttgactgaatttcagccacaccagttatggaccaccttactttctctgacatttgtcaaaacaactctctcattggattatgcatggaaaacaacggctatggtactatctatcgtatctctctttcctttatgcctgtctacgacctcccaaaaaacaacatggcttccggtgttgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccccccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtatcttcaagactcctgaaggcgaagttggagccatagctctagatttcaaacccggcacatctggatctcccattgtgaacagagagggaaaaatagtgggtctttatggaaacggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaattttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgctcagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaatcaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtatctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttaggatgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacggccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgacattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctggatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcaaacgcggcaataggagcagtgttcgttgatgagaaccaatggaactcagcaaaagaagcagtggaagacgaaaggttttgggatctcgtgcacagagagagggagcttcataaacagggaaaatgtgccacgtgtgtctataacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacggaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggtttgcaacagccttgacagctctgaatgacatgggaaaagtaagaaaagacacaccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagctataaaccaagtgagaaggctcatcgggaatgagaattatctagattatatgacatcaatgaagagattcaagaatgagagtgatcccgaaggagcactctggtaa

SEQ ID NO: 5340 - RNA, 9879 nt, synthetic construct
  misc_feature 1..9879: note = derived and/or modified CDS sequence (wt) from DENV-1__GQ868562__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggattactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaacaaaccaacattggacattgaactcttgaagacggaggtcacgaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaacatgagaacttaaaatattcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagataccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggcctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagcgacgctattcttcctatcaggaaaaggtttagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaattgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtagcagtggaaccagaggtagccaacctagatattattggccagaggatagagaatataaaaaatgaacataagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgatactacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaatcaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaacagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5341 - RNA, 9879 nt, synthetic construct
  misc_feature 1..9879: note = derived and/or modified CDS sequence (wt) from DENV-1__GQ868563__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaagagtggagacctgggctttgagacacccaggattcacggtgatagccctctttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggttacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgcaaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattagactgctcacctagaacaggtctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaattgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgcggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattagaccacaacccatggaacacaaatactcatggaaaagctggggaaaagctaaaatcataggagcagacatacaaaatgccaccttcatcatcgacggcccagataccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggccgttttcctccttcttataatgggacaactgacatggaatgatctgactaggttatgcatcatggttggagctaatgcctcagacaggatggggatgggaacaacgtacctagccttgatggctactttcaaaatgagaccaatgttcgctgttgggctattatttcgcagactgacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttgctgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggcaattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggattatggaacacgggagaagaagtgcaggtgatagctgttgaaccaggaaaaaaccccaaaaatgtacagacaacgccgggtaccttcaagactcctgaaggcgaagttggagccatagctctagacttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagtcgttgcctctgaaatggcagaggcactcaagggaatgccaataagatatcagacaacagcagtcaagagtgaacacacaggaagagagatagttgacctcatgtgccacgctacttttaccatgcgtctcttatccccagtgagagttcccaattacaacatgattattatggatgaagcacattttaccgatccagccagcatagcggccagaggatacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacttttgacactgagtaccagaaaacaaaaaacaatgactgggactatgttgtcacaacagacatttccgaaatgggagcaaatttccgggccgacagggtaatagacccaaggcggtgcctgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctcttcgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactctgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctattcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggctatgcagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtaccacttctcgccttagggtgctattcccaggtaaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctgggccaaataatgttactgatactttgtacatcacagattctcttgatgcggaccacatgggccttgtgtgaatccatcacactggctactggacccctgaccactctctgggagggatctccaggaaaattctggaacaccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtacccaacctagatattattggccagaggatagagaatataaaaaatgaacacaagtcaacatggcattatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttgtggggtttcctttccagaaacaagaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaaaagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcagatgatacagccggatgggacacaagaataacggaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggctggaaaaacatggcgccgaaaggctgaaacgaatggcaatcagcggagatgattgcgtggtgaagccaattgacgacaggttcgcaacagccttaacagctctgaatgacatgggaaaagtaagaaaagacataccgcagtgggagccttcaaaaggatggaatgattggcagcaagtgcccttctgttcacaccatttccaccagctgatcatgaaggatgggagggaaatagtggtgccatgccgcaaccaagatgaacttgtgggcagggctagagtgtcacaaggcgccggatggagcctgagagaaactgcttgcctaggcaagtcatatgcacaaatgtggcagctgatgtacttccacaggagagacctgagactagcggctaacgctatctgttcagccgtcccagttgaatgggtcccaaccagccgcacaacctggtcaatccatgcccatcaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5342 - RNA, 9879 nt, synthetic construct
  misc_feature 1..9879: note = derived and/or modified CDS sequence (wt) from DENV-1__GQ868564__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaaggcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagcccttacattggactgctcacctagaacagggctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgactcagaatgggagattgataacagccaaccccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggtgttctgttcagcggtgtttcttggaccatgaaaataggaatagggattctgttgacatggttgggattaaactcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctatacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtagatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagagggaggagaatctagttagatcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggcaattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacacgaagcagaacactccggcgcctcacacaacatattagtagaggtccaagatgatggaactatgaaaataaaagatgaagagagggatgacacactcactatactccttaaagcagctttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatttatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgcctggtaccttcaagactcctgaaggcgaagttggagccatagctctagacttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaattttggctcccacaagagtcgttgcctctgaaatggcagaggcactcaagggaatgccaataagatatcagacaacagcagtcaagagtgaacacacaggaagagagatagttgacctcatgtgccacgctacttttaccatgcgtctcctatccccagtgagagttcccaattacaacatgatcattatggatgaagcacattttaccgatccagccagcatagcggccagaggatacatctcaacccgagtgggtatgggtgaagcagctgcgatctttatgacagccactcccccaggatcagtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcctgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcactggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactctgacagaaggtggtgctttgatggggaaaggaacaaccaggtgttggaggagaacatggacgtggagatctggacaaaggaaggagaaagaaagaaattgcgacctcgctggttggatgccagaacatattctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctatagacatgctatggaggaactaccagacaccatagaaacattgatgcttctagctttgatagctgtgttgactggtggagtgacgctattcttcctatcaggaaaaggtctagggaaaacatctattggcttgctctgtgtgacggcctcaagcgcattgttatggatggccagtgtggagccccattggatagcggcctccatcatactagagttctttttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactacaagcaaaggccactagagaagctcaaaaaaggacagcggccggaataatgaaaaatccaaccgtagacgggattgttgcaatagacttggatcctgtggtctatgatgcaaaatttgagaaacagctgggccaaataatgttattgatactttgtacatcacagattctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagctggtctggctttttcattaatgaagtctttaggaggaggtaggagaggtacgggagctcaaggggaaacactaggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacattacgtgttctaaaaatggtggaaccatggctcagaggaaaccaattctgcataaaaatcctaaatccttacatgccaagtgtggtagaaaccctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcttatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaagccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgaatgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactttggtaa

SEQ ID NO: 5343 - RNA, 9879 nt, synthetic construct
  misc_feature 1..9879: note = derived and/or modified CDS sequence (wt) from DENV-1__GQ868565__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaagagtggagacctgggctttgagacacccaggattcacggtgatagccctctttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggttacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgcaaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattagactgctcacctagaacaggtctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgcggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattagaccacaacccatggaacacaaatactcatggaaaagctggggaaaagctaaaatcataggagcagacatacaaaatgccaccttcatcatcgacggcccagataccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggccgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgttgggctattatttcgcagactgacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttgctgtctctgacatttgtcaaaacaactctctcattggattatgcatggaaaacaacggctatggtactgtctatcgtatctctctttcctttatgcctgtccacgacctcccaaaaaacaacatggcttccggtgctgttaggatcttttggatgcaaaccattaaccatgtttcttataacagaaaacaaaatctggggaaggaaaagttggcccctcaatgaaggaattatggcaattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggattatggaacacgggagaagaagtgcaggtgatagctgttgaaccaggaaaaaaccccaaaaatgtacagacaacgccgggtaccttcaagactcctgaaggcgaagttggagccatagctctagacttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagtcgttgcctctgaaatggcagaggcactcaagggaatgccaataagatatcagacaacagcagtcaagagtgaacacacaggaagagagatagttgacctcatgtgccatgctacttttaccatgcgtctcttatccccagtgagagttcccaattacaacatgattattatggatgaagcacattttaccgatccagccagcatagcggccagaggatacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggagcaaatttccgggccgacagggtaatagacccaaggcggtgcctgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctcttcgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactctgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacacttgacgctaagagcccagaatgctctggacaacttggtcatgttgcacaattccgaacaaggaggaaaagcctacagacatgctatggaggaactaccagacactatagaaacattgatgcttctagctttgatagctgtgttgactggtggagtgacgctattcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggctatgcagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtaccacttctcgccttagggtgctattcccaggtaaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctgggccaaataatgttactgatactttgtacatcacagattctcttgatgcggaccacatgggccttgtgtgaatccatcacactggctactggacccctgaccactctctgggagggatctccaggaaaattctggaacaccacgatagcagtgtccatggcaaacatcttcaggggaagttatctagcaggggcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctggactgaagaaagttactgaagtgaagggatacacaaaaggaggacctggacatgaggaacctatcccaatggcgacctatggatggaacctagtaaagctacactctggaaaagatgtattttttatgccacctgagaaatgtgatacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagctaaacgaggcacaacacaaattatggaggtgacagccaagtggttgtggggtttcctttccagaaacaagaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcggatgatacagccggatgggacacaagaataacggaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaagccaattgacgacaggttcgcaacagccttaacagctctgaatgacatgggaaaagtaagaaaagacataccgcagtgggagccttcaaaaggatggaatgattggcagcaagtgcccttctgttcacaccatttccaccagctgatcatgaaggatgggagggaaatagtggtgccatgccgcaaccaagatgaacttgtgggcagggctagagtgtcacaaggcgccggatggagcctgagagaaactgcttgcctaggcaagtcatatgcacaaatgtggcagctgatgtacttccacaggagagacctgagactagcggctaacgctatctgttcagccgtcccagttgaatgggtcccaaccagccgcacaacctggtcaatccatgcccatcaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5344 - RNA, 9879 nt, synthetic construct
  misc_feature 1..9879: note = derived and/or modified CDS sequence (wt) from DENV-1__GQ868568__SS-prME
  source 1..9879: mol_type = other RNA
tccgtgaccatgctcctcatgctgctgcccacagccctggcgttccatttgaccacacgaggaggagagccacacatgatagttagtaagcaggaaagaggaaagtcactcttgtttaagacctctgcaggtgtcaatatgtgtactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgttataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaggaacaggacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaattttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggggacaccgcatgggacttcggttctataggaggagtgtttacatctgtgggaaaattggtacatcaggtttttggaaccgcatatggggttctgttcagcggtgtttcttggatcatgaaaataggaatagggattctgttgacatggttgggattaaattcaaggagcacgtcactttcgatgacgtgcattgcagttggcatggtcacactgtatctaggagtcatggttcaagcggactcaggatgtgtaattaactggaagggcagagaacttaaatgtggaagtggcatttttgtcaccaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaatcataggagcagacacacaaaataccaccttcatcatcgacggcccagacaccccagaatgtcccgatggccaaagagcatggaacatttgggaagttgaggactacgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgctgggtcaggagaagtggacagtttttcattaggaatattatgcgtatcaataatgattgaagaagtgatgagatccagatggagtagaaagatgctgatgactggaacactggctgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctgggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctcttccctttatgcctgtctacgacctcccaaaaaacaacatggcttccggtactgttaggatcttttggatgcaaaccattaaccatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatctatcattggagaaggcggctgaggtgtcctgggaacaagaagcagaacactccggtgcctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctacagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccagggaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtgggacctacgtcagtgccattgcccaagctaaagcatcacaggaagggcctctaccagagattgaggacgaggtgtttaagaagagaaacttaacaataatggacctgcacccaggatcaggaaaaacaagaagatatcttccagccatagtccgtgaggccataaaaaggaaactgcgtacgttaatcttggctcccacaagagtcgtcgcctctgaaatggcagaggcactcaagggaatgccaataagatatcagacaacagcagtcaaaagtgaacacacaggaagggagatagttgacctcatgtgccacgccacttttaccatgcgtctcttatccccagtgagagttcccaactacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttatatgggacagcctttaaataatgatgaggatcatgctcattggacagaagcaaaaatgctccttgacaatataaacacaccagaagggatcatcccagccctctttgagccagagagagaaaagagtgcagcagtagacggggagtatagactgcggggagaagcaaggaaaacgttcgtggagctcatgagaagaggagatctaccagtctggctatcctacaaagtagcctcagaaggtttccagtactctgacagaaggtggtgctttgatggggaaaggaacaatcaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaataggaaaacttccacaacatttgacgctaagagcccagaatgctctggacaacttggtcatgttgcacaattctgaacaaggaggaaaagcctacagacatgctatggaggaactaccagacaccatagaaacattgatgcttctagctttgatagctgtgttgactggtggagtgacgctattcttcctatcaggaaaaggtctagggaaaacatctattggcttgctctgtgtgacggcctcaagcgcactgttatggatggccagtgtggagccccattggatagcggcctccatcatactagagttcttcttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcagccggaataatgaaaaatccaaccgtagacgggattgttgcaatagacttggatcctgtggtttatgatgcaaaatttgaaaaacagctgggccaaataatgttactgatactttgtacgtcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatccttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctatgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctggtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgtcatccccatggtcacacaaatagctatgactgataccacaccctttggacaacagagagtgtttaaagagaaagttgacacgcgcacaccaagagcaaaacgaggcacaacacaaattatggaggtgacggccaagtggttgtggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagttgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggccaacgctatctgttcagccgtcccagttgaatgggtcccaaccagccgcacaacctggtcaatccatgcccaccaccaatggatgacaacagaagacatgttatcagtgtggaatagggtttggatagaggaaaacccatggatggaggacaaaactcatgtatccagctgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5345 - RNA, 9879 nt, synthetic construct
  misc_feature 1..9879: note = derived and/or modified CDS sequence (wt) from DENV-1__GQ868569__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaagagtggagacctgggctttgagacacccaggattcacggtgatagccctctttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggttgcgaaccccgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgcaaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattagactgctcacctagaacaggtctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagttaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgcggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattagaccacaacccatggaacacaaatactcatggaaaagctggggaaaagctaaaatcataggagcagacatacaaaatgccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgctgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggccgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgttgggctattatttcgcagactgacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttgctgtctctgacatttgtcaaaacaactctctcattggattatgcatggaagacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggcaattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggattgttgggcaggtcccaagtaggagtgggagtcttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggattatggaacatgggagaagaagtgcaggtgatagctgttgaaccaggaaaaaaccccagaaatgtacagacaacgccgggtaccttcaagactcctgaaggcgaagttggagccatagctctagacttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacacgaagatatcttccagccatagtccgtgaggccataaaaaggaaactgcgtacgttaatcttggctcccacaagagtcgttgcctctgaaatggcagaggcactcaagggaatgccaataagatatcagacaacagcagtcaagagtgaacacacaggaagagagatagttgacctcatgtgccacgctacttttaccatgcgtctcttatccccagtgagagttcccaattacaacatgattattatggatgaagcacattttaccgatccagccagcatagcggccagaggatacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggagcaaatttccgggccgacagggtaatagacccaaggcggtgcctgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctcttcgagccagagagagaaaagagtgcagcaatagacggggagtacagactgcggggagaagcaaggaaaacgttcgtggagctcatgagaagaggagatctaccagtttggctatcctacaaagtagcctcagaaggttttcagtactctgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctattcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggctatgcagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtaaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctgggccaaataatgttactgatactttgtacatcacagattctcttaatgcggaccacatgggccttgtgtgaatccatcacactggctactggacccctgaccactctctgggagggatctccaggaaaattctggaacaccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgcgctgggctgaagaaagttaccgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgactgataccacaccatttggacaacagagagtgtttaaagagaaagttgacacgcgcacaccaagagcaaaacgaggcacaacacaaattatggaggtgacagccaagtggttgtggggcttcctttccagaaacaagaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcagatgatacagccggatgggacacaagaataacggaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaagccaattgacgacaggttcgcaacagccttaacagctctgaatgacatgggaaaagtaagaaaagacataccgcagtgggagccttcaaaaggatggaatgattggcagcaagtgcccttctgttcacaccatttccaccagctgatcatgaaggatgggagggaaatagtggtgccatgccgcaaccaagatgaacttgtgggcagggctagagtgtcacaaggcgccggatggagcctgagagaaactgcttgcctaggcaagtcatatgcacaaatgtggcagctgatgtacttccacaggagagacctgagactagcggctaacgctatctgttcagccgtcccagttgaatgggtcccaaccagccgcacaacctggtcaatccatgcccatcaccaatggatgacaacagaagacatgctatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgaggaggctcatcgggaatgagaattatctagattacatgacatcaatgaagagattcaagaatgagagtgatcccgaaggagcactctggtaa

SEQ ID NO: 5346 - RNA, 9879 nt, synthetic construct
  misc_feature 1..9879: note = derived and/or modified CDS sequence (wt) from DENV-1__GQ868570__SS-prME
  source 1..9879: mol_type = other RNA
tccgtgaccatgctcctcatgctgctgcccacagccctggcgttccatttgaccacacgagggggagagccacacatgatagtcagtaagcaggaaagaggaaagtcactcttgttcaagacctctgcaggtgtcaatatgtgcaccctcattgcgatggacttgggagagttgtgtgaggacacaatgacctacaaatgcccccggatcactgaggcggaaccagatgacgttgactgctggtgcaatgccacagatacatgggtgacctatgggacgtgttctcaaaccggcgaacaccgacgagacaaacgttccgtggcactggccccacacgtgggacttggtctagaaacaagaaccgaaacatggatgtcctctgaaggcgcatggaaacaaatacaaagagtggagacctgggctttgagacacccaggattcacggtgatagccctttttctagcacatgctataggaacatccatcactcagaaagggatcattttcatcctgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatctgctggtcacattcaagacagctcatgcaaagaaacaggaagtggtcgtactaggatcacaggaaggagcaatgcacactgcgttgactggggcgacagaaatccagacgtcaggaacgacaacaatcttcgcaggacacctgaaatgcagactaaaaatggataaactgactttaaaagggatgtcatatgtgatgtgcacaggttcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaagtttttggaaccgcatatggggttctgttcagcggtgtttcttggaccatgaaagtaggaatagggattctgttgacatggttgggattaaattcaaggagcacgtcactttcgatgacgtgcattgcagttggcatggtcacactgtacctaggagtcatggttcaagcggatttgggatgtgtaattaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagtcacgcgtcttgagaacatcatgtggaagcaaatatcaaatgaattgaaccacattctacttgaaaatgacatgaaattcacagtggttgtaggagatgctaacggaattttggcccaagggaagaaaatgattaggccacaacccatggagcacaaatactcatggaaaagttggggaaaagctaaaatcataggagcagacacacaaaataccacctttatcatcgacggcccagacaccccagaatgtcccgacggccaaagagcatggaacatctgggaagttgaggactatgggtttggaattttcacgacaaacatatggctgaaattgcgtgactcctacacccaaatgtgtgaccaccggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacttaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacatcagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattgaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacacttactatactccttaaagcaactttgctggcagtctcaggagtgtacccaatgtcaataccagcaactctttttgtgtggtatttttggcagaaaaagaaacaaagatcaggagtgttatgggatacacccagccctccggaagtggaaagagcagttcttgatgatggcatctatagaatcttgcaaagaggactgttgggcaggtcccaagtaggagtgggagtcttccaagacggcgttttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaacgtacagacaacgccgggtaccttcaagactcctgaaggcgaagttggagccatagctctagatttcaaacccggcacatctggatctcccattgtgaacagagaggggaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattaccgattttccaggtaaaacagtctggtttgttccaagcattaaatcaggaaatgacattgccaactgtttaagaaagaacggaaaacgggtaatccaattgagcaggaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaagaaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacttaatattggaaatagggaaacttccacaacatttgacgctgagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctattcttcctatcaggaaaaggtctagggaaaacatctattggcttgctctgcgtgacggcctcaagcgcactgttatggatggccagtgtggagccccattggatagcggcctccatcatattagagttctttttgatggtgctgctcattccagagccagacaaacagcgcactccacaggacaaccagctagcatatgtggtgataggtttgttattcatgatactggcagtggcagccaatgagatgggattattggaaaccacaaagaaagacctggggattggctatgtagccaccgaaaaccaccaacatgctacaatgctggacgtagacctacgcccagcttcagcctggaccctctatgcagtagccacaacagttatcactcccatgatgagacacacaattgaaaatacaacggcaaatatttccctgacagccattgcaaatcaggcagctatattgatgggacttgacaagggatggccaatatcgaagatggacataggggttccacttctcgccttagggtgctactcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgcacatcacagatcctcttgatgcggaccacatgggccttgtgtgaatccatcacactggctactggacccctaaccactctctgggagggatctccaggaaaattctggaataccacgatagcagtgtccatggcaaacatcttcagaggaagttatctagcaggagcaggtctggctttttcattaatgaaatccttaggaggaggtaggagaggtacgggagctcaaggggaaacactgggagagaaatggaaaagacagttaaaccaactgagcaagtcagaattcaacatctacaaaaggagtgggattatggaggtggacagatccgaagccaaagagggactgaaaagaggagaaacaaccaaacatgcagtgtcgagaggaacggccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttgcgtgttctaaaaatggtggaaccatggctcagaggaaaccaattctgcataaaaatcctaaatccttacatgccaagtgtggtagaaactctggagcaaatgcaaagaaaacacggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcttatcatggatcatatgaggtcaagccatcaggatcagcctcatctatggtgaatggagtggtgagattgctcacaaaaccatgggatgtcatccccatggtcacacaaatagctatgactgataccacaccctttggacagcagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggctataggagcagtgttcgttgatgaaaaccaatggaattcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctactggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaacactttcaccaatatggaggtccaactaataagacaaatggagtctgaaggaatctttttacccagcgaattggaaacccccaacctagctgagagagttcttgactggttggaaaaacatggcgctgaaaggctgaaacgaatggcaatcagcggagatgattgcgtggtgaaaccaattgacgacaggttcgcagcagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcctgtctaggcaagtcatatgcacaaatgtggcagctgatgtacttccacaggagagacctgagactagcggctaacgctatctgttcagccgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgaaaattatctagattacatgacatcaatgaagagattcaagaatgagagtgatcccgaaggagcactctggtaa

SEQ ID NO: 5347 - RNA, 9879 nt, synthetic construct
  misc_feature 1..9879: note = derived and/or modified CDS sequence (wt) from DENV-1__KJ189302__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaacttcgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggattgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaagttgcgtgactcctacacccaaatgtgtgaccaccggctaatgtcagctgccatcaaggacagcaaggcagtccatgctgacatggggtactggatagaaagtgaaaagaacgaaacctggaagctggcgagggcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttctcataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtagctagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaatcaggtgttggaagagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcagccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgagtccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggaattcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacggcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5348 - RNA, 9879 nt, synthetic construct
  misc_feature 1..9879: note = derived and/or modified CDS sequence (wt) from DENV-1__KJ189303__SS-prME
  source 1..9879: mol_type = other RNA
tccgtgaccatgctcctcatgctgctgcccacagccctggcgttccatttgaccacacgaggaggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgttataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaggaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaacgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaattttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggggacaccgcatgggacttcggttctataggaggagtgtttacatctgtgggaaaattggtacatcaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtatctaggagtcatggttcaagcggactcgggatgtgtaattaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaatcataggagcagacacacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgctgggtcaggagaagtggacagtttttcattaggaatattatgcgtatcaataatgattgaagaagtgatgagatccagatggagtagaaagatgctgatgactggaacactggctgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctgggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatctatcattggagaaggcggctgaggtgtcctgggaacaagaagcagaacactccggtgcctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctacagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtgggacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagtcgtcgcctctgaaatggcagaggcactcaagggaatgccaataagatatcagacaacagcagtcaaaagtgaacacacaggaagggagatagttgacctcatgtgccacgccacttttaccatgcgtctcttatccccagtgagagttcccaactacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttatatgggacagcctttaaataatgatgaggatcatgctcattggacagaagcaaaaatgctccttgacaatataaacacaccagaagggatcatcccagccctctttgagccagagagagaaaagagtgcagcagtagacggggagtacagactgcggggagaagcaaggaaaacgttcgtggagctcatgagaagaggagatctaccagtttggctatcctacaaagtagcctcagaaggtttccagtactctgacagaaggtggtgctttgatggggaaaggaacaatcaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaataggaaaacttccacaacatttgacgctaagagcccagaatgctctggacaacttggtcatgttgcacaattctgaacaaggaggaaaagcctacagacatgctatggaggaactaccagacaccatagaaacattgatgcttctagctttgatagctgtgttgactggtggagtgacgctattcttcctatcaggaaaaggtctagggaaaacatctattggcttgctctgtgtgacggcctcaagcgcactgttatggatggccagtgtggagccccattggatagcggcctccatcatactagagttcttcttgatggtgctgctcattccagagccagatagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcagccggaataatgaaaaatccaaccgtagacgggattgttgcaatagacttggatcctgtggtttatgatgcaaaatttgaaaaacagctgggccaaataatgttactgatactttgtacgtcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctatgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacggccaagtggttgtggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagcggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagttgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgaatgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5349 - RNA, 9879 nt, synthetic construct
  misc_feature 1..9879: note = derived and/or modified CDS sequence (wt) from DENV-1__KR028435__SS-prME
  source 1..9879: mol_type = other RNA
tctgtgaccatgctccttatgctgatgcctacagccttggcattccatttgactacacgagggggagagccgcacatgatagtcagcaagcaggaaagaggaaagtcacttttgtttaagacctcagcaggtgtcaacatgtgcaccctcatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattttgttaatgctggttacaccatctatggccatgcgatgcgtgggaataggcagcagggacttcgtggaaggactgtcaggagcaacttgggtagatgtggtgttggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggatgtgggctcttcggaaaaggaagccttataacgtgtgccaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgttcacctagaacaggactggacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaaatgtagactaaagatggacaaactgactctaaaagggatgtcatatgtgatatgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaggctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtgggagtggcatttttgtcactaatgaagttcacacttggacagagcaatacaaatttcaagctgattccccaaagagactatcagcagccattgggaaggcatgggaggagggtgtgtgtggaattcgatcagcaacccgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaagctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaagacagcaaggcagttcatgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcatctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacctacctagctctgatggccacttttaaaatgagaccaatgtttgccgtagggctactattccgcagactaacatccagagaagttcttcttctaacaattggattgagtctagtggcatctgtggagttaccaaattccttggaggagctgggggatggacttgcaatgggcattatgatcttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccattgatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcaatttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtgggggtaggagtgtttcaagaaaacgtgttccacacaatgtggcatgtcaccaggggagctgtactcatgtaccaagggaagagactggaaccgagctgggccagtgtcaaaaaagacctgatctcatatggaggaggttggaggcttcaaggatcctggaacacgggagaagaagtgcaggtgattgctgttgaaccagggaaaaatcccaaaaatgtacaaacagcgccgggcacttttaagacccctgaaggcgaagttggagccattgccctagattttaagcccggcacatctggatctcccatcgtgaacagagaagggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctgcatccaggatcgggaaaaacaagaagatacctaccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattataacatgattattatggatgaagcacatttcaccgatccatccagcatagcggctagagggtacatctcaacccgagtgggcatgggtgaagcagctgcgattttcatgacagccactcccccaggatcagtggaggcctttccacagagcaacgcagttatccaagatgaggaaggaggaatttctgagagatcatggaactcaggttatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcatcttagcaggaccgatgccagtgactgtggctagtgccgcccagaggagaggaagaattggaaggaaccacaacaaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcggcaatagacggggaatacagactgcggggtgaagcaaggaaaacgtttgtggagctcatgagaagaggagatctacctgtctggctatcctacaaagttgcctcagaaggcttccaatactctgacagaagatggtgctttgacggggaaaggaacaaccaggtgttggaagagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggataacctggtcatgttgcacaactccgaacaaggaggaagagcctatagacatgcaatggaagaactgccagacaccatagaaacgttaatgctcctagctttgatagctgtgttaactggtggagtgacgctattcttcctatcaggaaggggcttagggaaaacatctatcggcctactctgcgtgatggcttcaagcgtattgctatggatggccagtgtagagccccattggatagcggcctccatcatactggagttcttcctgatggtgctgctcattccagagccagacagacaacgcactccgcaggacaatcagctggcatatgtggtgataggtttgttattcatgatactaacagtagcagccaatgagatgggactgctggaaaccacaaagaaagacttagggattggccatgtggctgttgaaaaccaccaccatgccacaatgctggacgtagacttacatccagcttcagcctggaccctctatgcagtggccacaacaatcatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggcccattacgctataattggacctggactgcaagcaaaagctactagagaagctcaaaaaaggacagcggccggaataatgaaaaatccaactgttgatggaatcgttgcaatagacttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaggtgaagggatacacaaaaggaggacctggacacgaagaaccaatcccaatggcgacctatggatggaacctagtaaagctgtactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctggtgcgaaatccactttcaagaaattccactcatgaaatgtattgggtttcatgtggaacaggaaacattgtgtcagcagtaaacatgacatccagaatgttgctaaatcggttcacaatggctcataggaaaccaacatacgaaagagacgtggacctaggcgccggaacaagacatgtggcagtagaaccagaggtagctaacctagatatcattggccagaggatagagaacataaaacatgaacacaagtcaacatggcattatgatgaggacaatccatataaaacatgggcctatcatggatcatatgaggtcaaaccatcaggatcagcctcatccatggtcaatggtgtggtgaaactgctcaccaaaccatgggatgtcatccccatggtcacacaaatagctatgactgacactacaccctttggacaacagagggtatttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcattgatgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtacgctgatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggttggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaactagccgcaccacctggtctatccatgcccatcaccaatggatgacaacagaagacatgctgtcagtgtggaatagagtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5350 - RNA, 9879 nt, synthetic construct
  misc_feature 1..9879: note = derived and/or modified CDS sequence (wt) from DENV-1__JQ922548__SS-prME
  source 1..9879: mol_type = other RNA
tctgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcattggccccacacgtgggacttggcctcgaaacaagaaccgaaacgtggatgtcctctgaaggcgcctggagacagatacaaaaagtggagacctgggccttgagacacccaggattcacggtgatagccctttttctagcacataccataggaacatccatcacccagaaagggatcatcttcattttgctgatgctggtgacaccatcaatggccatgcgatgtgtgggaataggcaacagagacttcgttgaaggactgtcaggagcaacatgggtggatgtggtactggagcatggaagctgcgtcaccaccatggcaagaaataaaccaacattggacattgaactcttgaagacggaggtcacgaaccctgccgtcttgcgcaaactgtgcattgaagctaaaatatcaaacaccaccaccgattcaagatgtccaacacaaggagaagccacactggtggaagaacaagacgcgaactttgtgtgtcgacgaacattcgtggacagaggctggggtaatggttgtggactattcgggaagggaagcttactgacgtgtgctaagtttaagtgtgtgacaaaacttgaaggaaaaatagttcaatatgaaaacttaaaatattcggtgatagtcactgtccacactggggaccagcaccaggtgggaaatgagactacagaacatggaacaattgcaaccataacacctcaagctcccatgtcggaaatacagctgaccgactacggagcccttacattggactgctcacctagaacagggctggactttaatgagatggtgctgttgacaatgaaagaaaagtcatggcttgtccacaaacaatggtttctagacttaccactgccttggacctcgggggcttcaacatctcaagagacttggaacagacaagatctgctggtcacatttaagacagctcaggcaaagaagcaggaagtagtcgtactggggtcacaagagggagcaatgcacactgcgttgactggggcgacagaaatccagacgtcaggaacgacgacaatgtttgcaggacacctgaaatgtagactaaaaatggataaactgactttgaaaggggcatcatatgtgatgtgcacaggcccttttaagctagagaaggaagtggctgagacccagcatggaactgtcctagtgcaggttaaatatgaaggaacagatgcaccatgcaagattccattttcaacccaagatgagaaaggagtgacccagaatgggagattgataacagccaatcccatagttactgacaaagaaaaaccagtcaacattgagacagaaccaccctttggtgagagctacatcgtgataggggcgggtgaaaaagctttgaaactaagctggttcaagaaaggaagcagcatagggaaaatgtttgaagctaccgcccgaggagcacgaaggatggccatcctgggagacacagcatgggacttcggttccataggaggggcgttcacatctgtgggaaaattggtacaccaggtttttggaaccgcatatggggtcttgttcagcggtgtttcttggaccatgaaaataggaatagggatcctgctgacatggctaggattaaactcaaggagcacgtcactctcgatgacgtgcattgcagttggcatggtcacactgtacctaggagtcatggttcaagcggactcggggtgtgtgatcaactggaaaggcagagaactcaaatgtggaagtggcatcttcgtcactaatgaagtccacacttggacagagcaatataaattccaggctgactccccaaaaagactatcagcagccattgggaaggcatgggaggaaggcgtgtgtggaattcgatcagccacacgtcttgagaacatcatgtggaagcaaatatcaaatgaattgaaccacattttacttgaaaatgacatgaaattcacagtggttgtaggagacgctaatggaatcttgacccaaggaaaaaagatgattaggccacaacccatggaacacaaatactcatggaaaagctggggaaaagccaaaattataggagcagatgcacagaatactaccttcatcatcgatggcccagacactccagaatgccctgatgaccagagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctaacgagagcctccttcatagaagtgaagacatgcacctggccaagatcccacactctatggagcaatggagtcctggaaagtgaaatgataatcccaaagatatatggaggaccaatatctcagcacaactacagaccagggtatttcacacaaacagcagggccatggcacctaggcaagttggaactagattttaatttgtgtgaaggcaccacagttgtagtggatgaacattgtggaaacgggggtgcatctcttggaactacaacagtcacaggaaagataatccatgaatggtgttgcagatcctgcacgctaccccccttacgcttcttaggagaagatggatgttggtatggcatggagatcagaccagttaaggagaaggaggagaatctattcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgcctcagacagaatagggatgggaacaacgtacctagccttgatggccactttcaaaatgagaccgatgttcgctgttgggctattatttcgcagactaacatccagagaggttctccttctcacaattggactaagcctggtggcatccgtggagctgccaaattctttagaagagctaggggacggacttgcaatgggcatcatgatgttaaaattattgactgattttcagtcacaccagttatggaccaccttactgtctctgacattcatcaaaacaactctctcattggattatgcatggaagacaatagctatggtattgtcaatcgtatctctctttcctctatgcctatccacgacctctcaaaaaacaacatggcttccggtgctgttaggatcttttggatccaaaccactaaccatgtttcttataacagaaaacaaaatctggggaaggaaaagttggcccctcaatgaaggaattatggctgttggaatagtcagcattttactaagttcactccccaaaaatgatgtgccactagccggcccactaatagctggaggcatgctgatagcatgttacgtcatatccggaagctcggccgatttatcattggagagagcggccgaggtctcctgggaagaagaggcagaacactctggcgcctcacacaacatactagtggaggtccaagatgatggaaatatgaaaataaaagatgaagaaagagatgattcgctcactatactcctcaaagcaactttgttggcagtttcaggggtgtacccaatgtcaataccagcaaccctttttgtgtggtatttctggcagaaaaagaaacagagatcaggagtcttgtgggacacacccagccctccagaagtggtaagagcagttcttgatgatggtatctatagaatcttgcaaagaggactattgggtaggtcccaggtaggagtgggagtttttcaggacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaaaaatgtacagacaacgcctggcactttcaagacccctgaaggcgaagttggagccatagccctagatttcaaacctggcacatctggatctcccatcgtgaacagagagggtaaaatagtaggtctttatggaaatggagtggtgacaacaagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccggccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagtcgatctcatgtgccacgccaatttcaccatgcgtctcctatccccagtgagagttcccaattacaacatgattatcatggatgaagcacactttactgatccagccagcatagcggccagggggtatatctcaacccgagtgggtatgggtgaagcagccgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaacgggaaacgggtgattcaattgagcagaaaaacctttgacactgaataccagaaaacaaaaaacaatgactgggactatgttgtcacaacagacatttccgaaatgggagcaaattcccgaaccgacagggtaatagacccaaggcggtgcttgaagccggtaatactaaaagatggcccagagcgcgtcattctagccggaccaatgccagtgaccgcggccagtgctgcccagaggagaggaagaattggaaggaaccaaaacaaggaaggtgaccagtatatatacatgggacagcctttgaataatgatgaggaccacgctcattggacagaagcaaaaatgctccttgacaatataaacacgccagaagggattatcccagccctctttgagccagagagagaaaagagtgcagcaatagacggggagtacagactgcggggagaagcaaggaaaacgttcgtggagctaatgagaagaggggatctaccagtttggctatcttacaaagttgcctcagaaggctttcagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcctatagacatgctatggaagaattaccagacaccatagaaacattgatgctactggctttgatagctgtgctgactggtggagttacgttgtttttcctatcaggaaaaggtctagggaaaacatccattggcctactttgtgtgatggcctcaagtgtactgttatggatggccagtgtggagccccattggatagcggcctccatcatactagagttttttctgaaggagctgctcattccagatgcagacggacagcgtactccacaggacaatcagctagcatatgtggtgataggtttgttattcatgatattgacagtggcagccaatgagatgggattactggaaaccacaaagaaaaacctggggattggccatgtagttgctgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaaccaggcggctatactgatgggacttgacaagggaaggccaatatctaagatggacataggagtgccacttctcgccttagggtgctattcccaggtgaacccactgacactgacagcggcggtgttgatgttagtggctcattatgccataatcggacctggactgcaagcaaaagctactagagaagcccaaaaaagaacagcggccggtttaatgaaaaatccaactgtagacgggattgctgcaatagatttggatcctgtggtttatgatgcaaaatttgaaaaacagctgggccaaataatgttactaatactctgcacatcacagattctcttgatgcggactacatgggccttatgtgaatccatcacactggctactggacccttgaccactctctgggagggatctcctggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtgggagaggtggctggtcatattactgcgccgggctgaagaaggttacagaagtgaagggatacacaaaaggaggacccggtcatgaggaacctatcccaatggcgacttatggatggaacctagtgaagctacactccggaaaggatgtattctttacaccacctgagaaatgtgacacccttttgtgtgacattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtgcaacaggaaacattgtgtcggcagtgaacatgacatccagaatgttgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggaacatatgaggtcaagccatcaggatcagcctcatccatggtgaacggcgtggtgagattgctcaccaagccatgggatgttatccccatggtcacacaaatagctatgactgataccacacccttcggacaacagagggtatttaaagagaaagttgacacacgcacaccaagaccaaaacgaggcacagcacaaattatggaggtgacagccaggtggttgtggggtttcctctctagaaataaaaaacccagaatctgcacaagagaggagttcacaagaaaagttaggtcaaacgcagcaattggagcagtgttcgttgatgaaaaccaatggaactcagcaaaagaagcagtggaagacgaaaggttctgggacctcgtgcacagagagagggagcttcataaacagggaaaatgtgccacgtgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagggagaattcacttagtggagtggaaggagaaggactacacaaacttggatacatacttagagacatatcaaagattccagggggaaatatgtatgcagatgacacagctggatgggacacaagaataacagaggatgacctccagaatgaggctaaaatcactgacatcatggagcccgaacatgctctactggctacgtcaatcttcaagctgacctatcaaaataaggtggtaagggtgcaaagaccagcaaaaagtggaaccgtgatggacgttatatccagacgtgaccagagaggaagtggacaggtcggaacttatggcttaaacactttcaccaacatggaggtccaactaataagacagatggaatctgaaggaatcttttcacccagcgaattggaaaattcaaatctagctgagagagctctcgactggttggaaaaacatggcgtcgaaaggttgaaaagaatggcaatcagcggagatgactgtgtggtgaaaccaactgatgacaggttcgcaacagctttaacagccctgaatgacatgggaaaagtgagaaaagacataccgcaatgtgaaccttcaaaaggatggaatgactggcagcaagtgcctttctgttcacaccatttccaccaactgatcatgaaggatgggagggagatagtggtgccatgccgtaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacttggtcgatccatgcccaccatcaatggatgacaacagaagacatgttatcagtatggaatagggtttggatagaggaaaacccatggatggaggacaaaactcatgtatccagctgggcagatgttccatacttaggaaaaagggaagatcaatggtgtggatccctgataggcttagcagcgagagccacctgggccaccaacatacaagtggccttaaaccaagtgagaaggctcattgggaatgagaattatttagactacatgacatcaatgaagaggttcaagaatgagagcgatcccgaaggagccctctggtaa

SEQ ID NO: 5351 - RNA, 9879 nt, synthetic construct
  misc_feature 1..9879: note = derived and/or modified CDS sequence (wt) from DENV-1__JQ922544__SS-prME
  source 1..9879: mol_type = other RNA
tccgtgaccatgctcctcatgctgctgcccacagctctggcgttccatttgaccacacgagggggagagccacacatgatagttagcaagcaggaaagaggaaagtcactcttgtttaagacctctgcaggtgtcaatatgtgcaccctcattgcgatggatttgggagagttatgtgaggacacaatgacctacaaatgcccccggatcactgaggcggaaccagatgacgttgactgctggtgcaatgccacagacacatgggtgacctatgggacgtgttctcaaactggcgaacaccgacgagacaaacgttccgtcgcactggccccacacgtgggacttggtctagaaacaagaaccgaaacgtggatgtcctgtgaaggcgcctggaaacaaatacaaaaagtggagatttgggctttgagacacccaggattcacggtgatagccctttttttagcacatgcgataggaacatccatcactcagaaagggattattttcattttgctgatgctggtaacaccatcaatggccatgcgatgtgtgggaataggcaacagagaattcgttgaaggactgtcaggagcaacgtgggtggacgtggtattggagcatggaagctgcctccacaccatggcacaaaataaaccaacattggacattgaactcctgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacgttcgtggacagaggctggggtaatggctgcggactattcggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagaccacaacccatggaacaattgcaaccataacacctcaagctcctacgtcggaaatacagctgaccgactacggagccctcacattggactgctcacctagaacagggttggactttaatgagatggtgctattgacaatgaaagaaaaatcatggcttgtccacaaacaatggtttctagacttaccactgccttggacttcgggggcttcaacatctcaagagacttggaacagacaagatttgctggtcacatttaagacagctcatgcaaagaagcaggaagtagtcgtactgggatcacaagaaggagcaatgcacactgcgttgactggggcaacagaaatccagacgtcaggaacgacaacaatctttgcaggacacctgaaatgcagactaaaaatggataaactgactttaaaagggatgtcatatgtgatgtgcacaggctcatttaagttagagaaggaagtggcagagacccagcatggaaccgttctagtgcaggttaaatacgaaggaacagatgccccatgcaagatccccttttcgacccaagatgagaaaggagtgacccagaatgggagattgataacagccaatcccatagttactgacaaagaaaaaccagtcaacattgaggcagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggttctataggaggagtgttcacgtctgtgggaaaattggtacatcaggtttttggaaccgcatatggggttctgttcagcggtgtttcttggatcatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaatcttggcccaagggaaaaaaatgattaggccacaacccatggaacacaaatactcatggaaaagctggggaaaagccaaaatcataggagcagacatacagaataccaccttcatcatcgacggcccagatactccagaatgccccgatgaccaaagagcatggaacatttgggaagttgaggactatgggtttggaattttcacgacaaacatatggctgaaactgcgtgactcctacacccaaatgtgtgaccaccggctaatgtcagctgccatcaaggacagcaaggcagtccatgctgatatggggtactggatagaaagtgaaaagaacgagacctggaagctagcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaactagattttgacttgtgtgaaggcaccacagttgttgtggaagaacattgtggaaatcgaggtccatctcttagaactacaacagtcacaggaaagataatccatgaatggtgttgcagatcctgcacgttaccccccttacgcttcaaaggagaagacggatgttggtatggcatggaaatcagaccagttaaggagaaggaagagaacctagttaggtcaatggtctctgcagggtcaggggaagtggacagtttttcattaggactactatgcgtatcaataatgattgaagaagtgatgagatccagatggagtagaaagatgctgatgactggaacactggctgttttcctccttcttataatgggacaactgacatggaatgatctgatcaggttatgcatcatggttggagccaatgcttcagacaggatggggatgggaacaacgtacctagccttgatggccactttcaaaatgagaccaatgttcgctgttgggctattatttcgcagactaacatccagagaagttcttcttctcacaattggattaagcctggtggcatccgtggagctaccaaattctttagaggagctaggggatggacttgcaatgggcatcatgatgttaaaattattgactgatttccagtcacaccagttatggactaccttattgtctctgacattcatcaaaacaactctttcattggattatgcatggaagacaatggctatggtactgtcaatcgtatctctctttcctttatgtctgtctacgacctctcaaaaaacaacatggcttccggtgctgttaggatcttttggatgcaaaccattaaccatgtttcttataacagaaaacaaaatctggggaaggaaaagttggcccctcaatgaaggaattatggctgttggaatagttagcattctactaagttcactcctcaaaaatgatgtgccgctagccggcccactaatagctggaggcatgctaatatcattttttgtcatatccggaagctcagccgatttatcattggagaaagcggctgaggtatcctgggaagaagaagcagaacactctggtacctcacacaacatattagtggaggtccaagatgatggaactatgaaaataaaagatgaagagagggatgacacactcaccatactccttaaagcaactctgctggcagtctcaggggtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagccgtcctcatgtaccaagggaagaggctggaaccaagctgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaggtgtttaggaaaagaaacttaacaataatggacctgcatccaggatcaggaaaaacaagaagatatcttccagccatagtccgtgaggccataaagaggaaactgcgcacgctaatcttggctcccacaagagttgtcgcctctgaaatggcagaggcgctcaagggaatgccaataagatatcagacaacagcagtgaagagtgaacacacaggaagggagatagttgacctcatgtgccacgccactttcaccatgcgtctcttatctccagtgagagttcccaattacaacatgattatcatggatgaagcacattttaccgatccagccagcatagcggccagagggtacatctcaacccgagtgggcatgggtgaagcagctgcgatctttatgacagccactcccccaggatcggtggaggcctttccacagagcaatgcagttatccaagatgaggaaagagacattcctgagagatcatggaactcaggctacgactggatcactgatttcccaggtaaaacagtctggtttgttccaagcatcaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggagcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgttaacatgggacaacctttaaataatgatgaggaccacgctcattggacagaagcaaaaatgctccttgacaatataaacacaccagaagggatcatcccagccctctttgagccggagagaaaaaagagtgcagcagtagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaagagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctttggacaacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatactagagttctttctgatggtgctgctcattccagagccagacagacagcgcactccacaagacaaccagctagcatatgtggtgataggtttgttattcatgatactgacagtggcagccaacgagatgggattattggaaaccacaaagaaagacctggggattggccatgtagccgccgaaaaccaccaccatgctacaatgctggacgtagacctacgtccagcttcagcctggaccctctatgcagtagccacaacaattatcactcccatgatgagacacacaattgaaaacacaacggcaaatatttccctgacagccattgcaaatcaggcagctatattgatgggacttgacaagggatggccaatatctttgatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgcacatcacagattctcttgatgcggaccacatgggccttgtgtgaatccatcacactggctactggacccttgaccactctttgggagggatctccaggaaaattctggaataccacgatagcagtatccatggcaaacatcttcaggggaagttatctagcaggagcaggtctggccttctcattaatgaaatctttaggaggaggtaggagaggtacgggagctcaaggggaaacactgggagaaaaatggaaaagacagctaaaccaactgagcaagtcagaattcaacatttacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatacacaaaaggaggacctggacatgaggaacctatcccaatggcgacctatggatggaacctagtaaagctacactctggaaaagatgtattctttacaccacctgagaaatgtgacacccttttgtgtgatattggtgagtcctctccgaatccaactatagaagaaggaagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaagttaggtcaaacgcagcaatgggagcagtgttcgttgatgaaaaccaatggaactcagcaaaagaagcagtggaagacgaaaggttttgggatctcgtgcacagagagagggagcttcataaacagggaaaatgtgccacgtgtgtctacaatatgatggggaagagagagaaaaaattaggagagtttggaaaggcaaaaggaagtcgtgcaatatggtacatgtggttgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcccgaacatgctctattggctacgtcaatttttaagctgacctaccaaaacaaggtggtaagggtgcaaagaccagcaaaaagtggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccctaatctagctgagagagttctcgactggttggaaaaacatggcgccgaaaggctgaaaagaatggcaattagcggagatgattgtgtggtgaaaccaattgatgacaggttcgcaacagccttaacagctctgaatgacatgggaaaagtaagaaaagacataccacaatgggaaccttcaaaaggatggaatgactggcagcaagtgcctttctgttcacaccatttccaccagctgatcatgaaggatgggagggagatagtggtgccatgccgcaaccaagacaaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcaccacctggtcgatccatgcccaccaccaatggatgacaacagaagacatgttatcagtgtggaataaggtttggatagaggaaaacccatggatggaggacaaaactcatgtatccagttgggaagatgttccatacttaggaaaaagggaagatcaatggtgtggatccctgataggcttaacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5352 - RNA, 9879 nt, synthetic construct
  misc_feature 1..9879: note = derived and/or modified CDS sequence (wt) from DENV-1__JQ922546__SS-prME
  source 1..9879: mol_type = other RNA
tccgtggccatgctccttatgctgctgcccacagccctggcgttccatttgaccacacgagggggagagccacacatgatagttagcaagcaggaaagaggaaagtcacttttgtttaagacctctgcaggtgtcaacatgtgcaccctcattgcgatggatttgggagagttatgtgaggacacaatgacctacaaatggccccggatcactgaggcggaaccagatgacgttgactgctggtgcaatgccacagacacatgggtgacctatggaacgtgttctcaaaccggcgaacaccgacgagacaaacgttccgtcgcactggccccacacgtggggcttggtctagaaacaagaaccgaaacgtggatgtcctctgaaggcgcctggaaacaaatacaaaaagtagagacttgggctctgagacacccaggattcacggtgatagccctttttctagcacatgccataggaacatccatcacccagaaagggatcattttcattttgctgatgctggtaacaccgtcaatggccatgcgatgtgtgggaataggcaacagagacttcgttgaaggactgtcaggggcaacgtgggtggatgtggtactggagcatggaagctgcgtcaccaccatggcaaaaaacaaaccaacattggacattgaactcttgaagacggaggtcacgaaccccgccgtcttgcgcaaattgtgcattgaagctaaaatatcaaacaccaccaccgattcaagatgtccaacacaaggagaagctacactggtggaagaacaagacgcgaactttgtgtgtcgacgaacgttcgtggacagaggctggggtaatggctgtggactattcggaaaaggaagcctactcacgtgtgctaagttcaagtgtgtgacaaaactagaaggaaagatagttcaatatgaaaacttaaaatattcagtgatagtcactgtccacactggggaccagcaccaggtgggaaatgagaccacagaacatggaacaattgcaatcataacacctcaagctcctacgtcggaaatacagctgaccgactacggagccctcacattggactgctcacctagaacagggctggactttaatgagatggtgctgttgacaatgaaagaaaaatcgtggcttgtccacaaacaatggtttctagacttaccactgccttggacctcgggggcctcaacatctcaagagacttggaacagacaagatctgctggtcacatttaagacagctcatgcaaagaagcaggaagtagtcgtactgggatcacaagaaggagcaatgcacactgcgttgacgggggcgacagaaatccagacgtcaggaacaacaacaatctttgcaggacacttaaaatgcagactaaaaatggataaactgactttaaaagggatgtcatatgtgatgtgcacaggctcatttaagttagagaaggaagtggctgagacccagcatggaaccgtcttagtgcaggttaaatacgaaggaacagatgcaccatgcaagatccccttttcgatccaagatgagaaaggagtgacccagaatgggagattgataacagccaatcccatagttactgacaaagaaaaaccagtcaacattgagacggaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggatttcggttctataggaggagtgttcacgtctgtgggaaaactagtacaccaggtttttggaaccgcatatggggttttgttcagcggtgtttcttggaccatgaaaataggaatagggattctgctgacatggctaggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactatcagcagccattgggaaggcatgggaggagggcgtgtgtggaattcgatcagccacacgtcttgagaacgtcatgtggaagcaaatatcaaatgaattgaaccacattctacttgaaaatgacatgaaatttacagtggttgtgggagatgttaatggaatcctggcccagggaaagaaaatgattaggccacaacccatggagcacaaatactcatggaaaagctggggaaaagccaaaatcataggagcagacatacagaatactaccttcattatcgacggcccagacactccagaatgccccgatgaccaaagagcatggaacatttgggaagttgaggactatgggtttggaattttcacgacaaacatatggctgaaattgcgtgactcctacacccaagtatgtgaccaccggctaatgtcagctgccatcaaggacagcaaggcagtccatgctgacatggggtactggatagaaagtgaaaagaacgagacctggaagttggcgagagcctcctttatagaagttaagacatgcacctggccaaaatcccacactctatggagcaatggagttctggaaagtgaaatgataatcccaaagatatatggaggaccaatatctcagcacaactacagaccagggtatttcacacaaacagcagggccatggcacctaggcaagttggaactagactttgatttatgtgaaggcaccacagttgttgtggatgaacattgtggaaatcgaggtccatctcttagaactacaacagtcacaggaaagataatccatgaatggtgttgcagatcctgcacgttaccccccttacgcttcaaaggagaagacggatgttggtatggcatggaaatcagaccagttaaggagaaggaagagaacctagtcaggtcaatggtctctgcagggtcaggagaagtggacagtttttcattaggactactatgcgtatcaataatgattgaagaagtgatgagatccagatggagtagaaagatgctgatgactggaacactggctgttttcttccttcttataatgggacaactgacatggaatgatctgttcaggttatgcatcatggttggagccaatgcttcagacaggatggggatggggacaacatatctagccctgatggccactttcaaaatgagaccaatgtttgctgttgggctattatttcgcagactaacatccagagaagttcttcttctcacaattggattaagcctggtggcatccgtggagctaccaaattctttagaggagctaggggatggacttgcaatgggcattatgatgttaaaattactgactgattttcagtcacaccagttatggactaccttactgtctctgacatttatcaaaacaactctttcattggattatgcatggaagacaatggccatggtactgtcaatcgtatctctctctcctttatgtctgtccacgacctctcaaaaaacaacatggcttccggtgctgttaggatcttttggatgtaaaccactaaccatgttccttataacagaaaacaaaatctggggaaggaaaagttggcccctcaatgaaggaattatggctgttggaatagttagcattctactaagttcactcctaaaaaatgatgtgccgctagccggcccactaatagctggaggcatgctaatagcatgttatgttatatccggaagctcagccgacttatcattggagaaagcggctgaggtctcctgggaagaagaggcagaacactctggtgcctcacacaacatactagtggaggtccaagatgatggaactatgaaaataaaagatgaagagagagatgacacactcaccatactccttaaagcatctctgctggcagtctcaggggtgtatccaatgtcaataccagcaaccctttttgtgtggtatttttggcagaaaaagaaacagagatcaggagtgttatgggacacacccagccctccagaagtggaaagagcagttcttgatgatggtatctatagaatcttgcaaagaggactgttgggcaggtcccaagtaggagtgggaattttccaagatggcgtgttccacacaatgtggcacgttaccaggggagctgtcctcatgtatcaagggaagaggctggaaccaagctgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggcatcttcaagacccctgaaggcgaagttggagccataaccctagatttcaaacccggcacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaagtgtttaggaaaagaaacttaacaataatggacctacatccaggatcaggaaaaacaagaaggtatcttccagccatagtccgtgaggccatgaaaaggaaactgcgcacgctaatcttggctcccacaagagttgtcgcctctgaaatggcagaggcgctcaagggaatgccaataagataccagacaacagcagtgaagagtgaacacacaggaagggagatagttgaccttatgtgccacgccactttcaccatgcgtctcctatctccagtgagagttcccaattacaacatgattatcatggatgaagcacattttaccgatccagccagcatagcggctagggggtacatctcaacccgagtgggtatgggtgaagcagctgcgatcttcatgacagccactcccccaggatcggtggaggccttcccacagagcaatgcagttatccaagatgaggaaagagacattcctgagagatcatggaactcaggctacgattggatcactgatttcccaggcaaaacagtctggtttgttccaagcatcaaatcaggaaatgacatcgccaactgtttaagaaagaacgggaaacgggtgatccaattgagtagaaaaacctttgacactgagtaccagaaaacaaaaaacaatgactgggactatgttgtcacaacagacatttccgaaatgggagcaaatttccgggccgacagggtaatagacccaaggcggtgcttgaaaccggtaatactaaaagaaggtccagagcgcgtcattctagccggaccgatgccagtgactgtggccagtgctgcccagaggagaggaagaattggaaggaaccaaaataaggaaggtgatcagtacgtttacatgggacagcctttaaataatgatgaggaccatgctcattggacagaagcaaaaatgctccttgaccatataaacacaccagaagggattatcccagccctctttgagccagaaagagagaagagtgcagcaatagacggggagtacaggctgcggggagaagcaaggaaaacgttcgtggagctcatgagaagaggagatctaccagtttggctatcctacaaagttgcctcagaaggcttccaatacaccgatagaaggtggtgctttgatggggaaaggaacaaccaggtgttggaggagaacatggacgtggagatctggatggaagaaggggaaaaaaagaaaattcgaccccgctggttggaaatagaaaaatattctgatccactggccctccgcgagtttaaagagttttcagcaaaaagaaaaagtgttttaggggacctaaaattagaaatagggaaacttccacaacatttgacgataaaggcccggaatgccttggacaacttggtcatgttgcacaattccgaacaaggaggaaaagcctatagacacgctatggaagaactaccagacaccatagaaacattgatgcgcttaggtttgatagctgtgatgactggtggagtgactctgtttttcctatcaggaaaaggtctagggaaaacatccaatggtctactctgtgtgatggcctcaagcgtactgctatggatggccagtgtggagccccattggatagcggcctccatcatactagagttctttctgatggtgctgctcattccagagccagatagacagcgcactccacaggacaaccagttagcatatgtggtgataggtttgttattcatgatattgacagtggcagccaatgagatgggattattggaaactacaaagaaagacctggggattggccatgtagtcgccgaaaaccaccaccatgctacaatgctggacgtagacctacatccagcttcagcctggaccctctatgcagtagctacaacaattatcactcccatgatgagacacacaattgaaaacacaacggcaaatatttccctgacagctattgcaaatcaggcagcaatattgatgggacttgacaagggatggccaatatcgaagatggacataggagttccacttctcgccttagggtgctattcccaggtgaacccattgacactgacagcggcggtgttgatgttagtggctcattatgccataattggacctggattgcaagcaaaagctacgagagaagctcaaaaaaggacagccccccaaataatgaagaatcaaattgtagacgggattgttgcagtagatttggatcctgtggtttacgatgcaaaatttgaaaaacagctaggccaaataatgttactgatactttgcacatcacagattctcttgatgcggactacatgggccttgtgtgaatccatcacactggctactggacctttgactactctttgggagggatctccaggaaaattctggaacaccacgatagcagtgtccatggcaaacatcttcaggggaagttatctagcaggagcaggtctggccttctcattaatgaaatctttaggaggaggcaggagaggcacgggagctcaaggggaaacactgggagagaaatggaaaagacagctaaaccaactgagtaagtcagaattcaacacttacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaagggaaagtcatagacctcggttgtggaagaggtggctggtcatactattgcgctgggctgaagaaagtcacagaagtgaagggatacacaaaaggaggacctggacatgaggaacctatcccaatggcgacctacggatggaacctagtaaagctacactctggaaaagatgtattctttacaccacctgagaaatgtgacacccttttgtgtgatattggtgagtcctctccgaatccaactatagaagaaggaagaacgttacgtgttctaaagatggtggaaccatggctcagaggaaaccaattttgcataaaaatcctaaatccttacatgccaagtgtggtggaaaccctggagcaaatgcaaagaaaacatggagggatgctagtgcgaaacccactctcaagaaattccacccacgaaatgtactgggtttcatgtggaacaggaaacattgtgtcggcagtgaacatgacatccagaatgttgctgaatcgattcacaatggctcacaggaagccaacatatgaaagagacgtggacttaggtgctggaacaagacatgtggcagtggaaccagaggtagccaacctagatatcattggccagaggatagagaacataaaaaatgaacataagtcaacatggcattatgatgaggacaatccatacaaaacatgggcctatcacggatcatatgaggtcaagccatcaggatcagcctcatccatggtgaatggcgtggtgagactgctcaccaaaccatgggatgttatccccacggtcacacaaatagctatgactgataccacacccttcgggcaacagagggtgttcaaagagaaagttgacacgcgcacaccaaaagcaaaacgaggtacagcacaaattatggaagtgacagccaattggttatggggcttcctttctagaaacaaaaaacccagaatctgcacaagagaggagttcacaagaaaagttaggtcaaacgcagcaattggagcagtgttcgttgatgaaaaccaatggaactcagcaaaagaagcagtggaagatgaaaggttttgggatcttgtgcacagagagagggagcttcataaacagggaaaatgtgccacgtgtgtctacaatatgatggggaagagagagaaaaaattaggagagtttggaaaggcaaaaggaagtcgtgcaatatggtacatgtggttgggagcacgctttctagagttcgaagcccttggtttcatgaatgaagatcactggttcagtagagagaattcactcagtggagtggaaggagaaggactacacaaactcggatacatactcagagacatatcaaagattccagggggaaatatgtatgcagatgacacagccggatgggacacaagaataacagaggatgatcttcagaatgaggctaaaatcactgacatcatggagcccgaacatgctctattggctacatcaatttttaagctgacctaccaaaataaggtggtaagggtgcaaagaccagcaaaaagtggaaccgtgatggatgtcatatccagacgtgaccagagaggaagtggacaggtcggaacttatggcttaaatactttcaccaacatggaggttcaactaataagacaaatggagtctgagggaatctttttacccagcgaactggaaacccctaatctagctgagagagtcctcaactggttggaaaaacatggcgtcgaaaggctgaaaagaatggcaatcagcggagatgactgtgtggtgaaaccaactgatgacaggttcgcaacagctttaacagctctgaatgacatggggaaagtaagaaaagacacaccgcaatgggaaccttcaaaaggatggaatgactggcagcaagtgcctttttgttcacaccatttccaccagctgatcatgaaggatgggagggagatagtggtgccatgccgcaaccaagatgaactcgtgggcagggccagagtatcacacggcgccggatggagcctgagagaaactgcttgcctaggcaagtcatatgcgcaaatgtggcagctgatgtacttccacaggagagacctgagactggcggctaatgctatctgttcagccgttccagttgattgggtcccaaccagccgcaccacctggtcgatccatgcccatcaccaatggatgacaacagaagacatgttatcagtgtggaatagggtctggatagaggaaaacccatggatggaggacaaaactcatgtatccagttgggaagatgttccatacttaggaaaaagggaagatcagtggtgtggatccattataggcttgacagcaagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5353 - RNA, 9879 nt, synthetic construct
  misc_feature 1..9879: note = derived and/or modified CDS sequence (wt) from DENV-1__JQ922545__SS-prME
  source 1..9879: mol_type = other RNA
tccgtgaccatgctccttatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcattggccccacacgtggggcttggtctagaaacaagaaccgaaacgtggatgtcctctgaaggcgcctggagacagatacaaaaagtggagacttgggccttgagacacccaggattcacggtgatagccctttttctagcacataccataggaacatccatcacccagaaagggatcatcttcattttgctgatgacgggagcacccatcatggccatgcgatgtgtgggaataggcaacagagacttcgttgaaggactgtcgggagcaccgtgggtggatgtggtactggagcatggaagctgcctctccaacatggcaaaaaataaaccaacattggacattgacttctttaagacggaggtcacgaaccctgccgtcttgcgcaaactgtgcattgaagctaaaatatcaaacaccaccaccgattcaagatgcccaacacaaggagaagctacactggtggaagaacaagacgcgaactttgtgtgtcgacgaacattcgtggacagaggctggggtaatggttgtggactattcgggaaaggaagcttactgacgtgtgctaagtttaagtgtgtgacaaaacttgaaggaaagatagttcaatatgaaaacttaaaatattcggtgatagtcactgtccacactggggaccagcaccaggtgggaaatgagaccacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactggggtcacaagaaggagcaatgcacactgcgttgactggggcgacagaaatccagatgtcaggaacgacgacaatcttcgcaggacacctgaaatgtagactaaaaatggataaactgactttaaaaggggtgtcatatgtgatgtgcacaggctcatttaagttagagaaggaagtggctgagacccagcatggaaccgtcctagtgcaggttaaatacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtgataggggcgggtgaaaaagctttgaaactaagctggttcaagaaaggaagcagcatagggaaaatgttcgaagctaccgcccgaggagcacgaaggatggctatcctgggagacacagcatgggacttcggttccataggaggggtgttcacatctgtgggaaaattggtacaccaggtttttggaaccgcatatggggtcttgttcagcggtgtttcttggaccatgaaaataggaatagggattctgctgacatggctaggattaaattcaaggagcacgtcactctcgatgacgtgcattgcagttggcatggtcacactgtacctaggagtcatggttcaagcggactcggggtgtgtgatcaactggaagggcagagaactcaaatgtggaagtggcatcttcgtcactaatgaagtccacacttggacagagcaatataaattccaggctgactccccaaaaagactgtcagcagccattgggaaggcatgggaggaaggcgtgtgtggaattcgatcagccacttgtcttgagaacatcatgtggaagcaaatatcaaatgaattgaaccacattctacttgaaaatgacatgaaattcacagtggttgtaggagacgctaatggaatcttgacccaaggaaaaaagatgattaggccacaacccatggaacacaaatactcatggaaaagctggggaaaagccaaaatcataggagcagatatacagaataccaccttcatcatcgatggcccagacactccagaatgccccgatgaccagagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccatctcttagaactacaacagtcacaggaaagataatccatgaatggtgttgcagatcctgcacgctaccccccttacgcttcaaaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacaggatggggatgggaacaacgtacctagccttgatggccactttcaaaatgagaccgatgttcgctgttgggctattatttcgcagactaacatccagagaggttctccttctcacaattggactaagcctggtggcatccgtggagctaccaaattctttagaggagctaggggacggacttgcaatgggcatcatgatgttaaaattattgactgattttcagtcacaccagttatggactaccttactgtctctgacattcatcaaaacaactctttcattggattatgcatggaagacaatagctatggtattgtcaatcgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagtcagcattttactaagttcactcctcaaaaatgatgtgccactagccggcccactaatagctggaggcatgctaatagcatgttacgtcatatccggaagctcagccgatttatcattggagaaagcggctgaggtctcctgggaagaagaagcacaacactctggtgcctcacacaacatactagtggaggtccaagatgatggaactatgaaaataaaagatgaagagagagatgacacgctcactatactccttaaagcaactctgttggcagtctcaggggtgtacccaatgtcaataccagcaaccctttttgtgtggtatttttggcagaaaaagaaacagagatcaggagtcttgtgggacacacccagccctccagaagtggaaagagcagttcttgatgatggtatctatagaatcttgcaaagaggactgttgggtaggtcccaagtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgagccagggaagaacccaaaaaatgtacagacaacgccgggcaccttcaagacccctgaaggcgaagttggagccatagccctagattttaaacccggcacatctggatctcccatcgtgaacagagagggaaaaatagtaggcctttatggaaatggagtggtgacaacaagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaagtgacattgccactgttttagaaaggagcagggaaccggtgatccaattaagcagaaaaacctttgacactgaataccagaaaacaaaaaacaatgactgggactatgttgtcacaacagacatttccgaaatgggagcaaatttccgggccgacagggtaatagacccaaggcggtgcttgaagccggtaataccaaaagatggcccagagcgcgtcattctagccggaccaatgccagtgaccgtggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaacacgccagaagggattatcccagccctctttgagccggagagagaaaagagtgcagcaatagacggggagtacagactgcggggagaagcaaggaaaacgttcgtggagctaatgagaagaggggatctaccagtttggctatcttacaaagttgcctcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagagaaacttccacagcatttgacgctaagggcccagaatgctttggacaacttggtcatgttgcacaattccgaacaaggaggaaaagcctatagacatgctatggaagaattaccagacaccatagaaacattgatgctcctagctttgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttcattctgatggtgctgctcattccagagccagacagacagcgtactccacaggacaatcagctagcatatgtggtgataggtttgttattcatgatattgacagtggcagccaatgagatgggattactggaaaccacaaagaaagacctggggattggccatgtagtcgccgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttacgatgcaaaatttgaaaaacagctaggccaaataatgttactgatactttgcacatcacagattctcttgatgcggactacatgggccttatgtgaatccatcacactggctactggacccttgaccactctctgggagggatctccaggaaaattctggaataccacgatagcagtgtccatggcaaacatcttcaggggaagttatctagcaggagctggtctggccttctcattaatgaaatctttaggaggaggtaggagaggtacgggagctcaaggggaaacattgggagaaaaatggaaaagacaactaaaccaactgagcaagtcagaattcaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctagtgaagctacactccggaaaagatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacatatgaaagagacgtggacttgggcgctggaacaagacatgtggcagtggaaccagagatagccaacctagacatcattggccagaggatagagaacataaaaattggacataagtcaacatggcattatgatgaggacaatccatacaaaacatgggcctatcatggatcatatgaggtcaagccatcagggtcagcctcatccatggtgaatggcgtggtgagattgctcaccaaaccatgggatgttatccccatggtcacacaaatagctatgactgataccacacccttcggacaacagagggtgtttaaagagaaagttgacacacgcacaccaagaccaaaacgaggcacagcacaaattatggaggtgacagccaagtggatgtggggtttcctctttagaaacagaccacccagaatttgcacaagagatgagttcgcaagaaaagttaggtcaagcacagcaaatggagcagtgttcgttgatgaaaatcaatggaactcagcaaaagaagcagtggaagacgaaaggttttgggacctcgtgcacagagagagggagcttcataaacagggaaaatgtgccacgtgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatatgtatgcagatgacacagctggatgggacacaagaataacagaggatgattcttcgaatgaggctaaaatcattgaactcatgaggcccgaacatgctttacttgctacgtcaatcttcaagctgaccttccaaataagtgtggtaagggtgcaaagaccagcaaaaagtggaaccgtgatggaatgtatatccagacgtgaccagaaaagaagtggacaggtcggaacttatggcttaaacactttcaccaacatggaggtccaactaataagacaaatggaatctgaaggaatcttttcacccagcgaaatggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaagtgagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggccagagtatcacaaggcgccggatggagcctgagagaaactgcttgcctaggcaagtcatatgcacaaatgtggcagctgatgtacttccacaggagagacctgagactagcggccaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtggccataaaccaagtgagaaggctcattgggaatgagaattatttagactacatgacatcaatgaagagattcaagaatgagagtgatcccgaaggagccctctggtaa

SEQ ID NO: 5354 - RNA, 9879 nt, synthetic construct
  misc_feature 1..9879: note = derived and/or modified CDS sequence (wt) from DENV-1__GU131887__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattagatatgaaggaacagatgcaccatgcaagatccctttttcgacccaagatgaaagaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgctagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctctttcccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggacgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggagaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaatgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgcgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccccgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggacgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccagaataaggtggtaagggtacagagaccagcaaaaaatggaaccgtgatggatgtcatatccagacgtgaccagagaggaagtggccaggttggaacttatggcttaaacacttttaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgccaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5355 - RNA, 9879 nt, synthetic construct
  misc_feature 1..9879: note = derived and/or modified CDS sequence (wt) from DENV-1__GU131888__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagccgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatcccttttttgacccaagatgaaaaaggagtaacccagaatgggagattgataacagctaaccctatagttactgacaaagaaaaaccagtcaacattgaggcagaaccgccctttggtgagagttacatcgtaataggagcaggtgaaaaagctttgaaactaagctggtttaagaaaggaagcagcatagggaaaatgtttgaggcaactgccagaggagcacgaaggatggccatactgggagacaccggatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaaactggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtctttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggacccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcactaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttgcatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgacgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagggagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgatagatttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggagcactctggtga

SEQ ID NO: 5356 - RNA, 9879 nt, synthetic construct
  misc_feature 1..9879: note = derived and/or modified CDS sequence (wt) from DENV-1__GU131892__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggtaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggttcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccagacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaagggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5357 - RNA, 9879 nt, synthetic construct
  misc_feature 1..9879: note = derived and/or modified CDS sequence (wt) from DENV-1__GU131893__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggtgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagataaaccaacattagacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaagggagcctaatgacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagcaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcccatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttctccttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcagggaaaacaagaagataccttccagccatagtccgtgaggccataaaaaggaagctgcgtacactaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggagccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggggcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgtctggctggaaaaatatggcgtcgaaaggctgaaaagaatggcaatcagcggagatgactgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5358 - RNA, 9879 nt, synthetic construct
  misc_feature 1..9879: note = derived and/or modified CDS sequence (wt) from DENV-1__GU131894__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagtcactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggactatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctatatgggacagcctttaaacaacgatgaagatcacgctcactggacagaagcaaaaatgcttcttgataatataaacacaccggaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatagattcacaatggctcacagaaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaggagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaggagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggtcggaacttatggtttaaacactttcaccaacatggaagcccagctgataagacaaatggagtctgagggaatcttttcacccagcgaattagagaccccaaacttagccgagagagttctcgactggttggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggaccccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaatcaagtgagaagactaattgggaatgagaattacctagattacatgacatcaatgaagagattcaagaacgagagtgatcccgaaggggcactctggtga

SEQ ID NO: 5359 - RNA, 9879 nt, synthetic construct
  misc_feature 1..9879: note = derived and/or modified CDS sequence (wt) from DENV-1__GU131895__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaagcagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtgctggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagatctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactggctctaaaagggatgtcatatgtgatgtgcacaggctcattcaagctagagaaagaagtggctgagacccagcatggaaccgttctagtgcagattaaatatgaaggaacagatgcaccatgcaagatccctttttcaacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgcatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaattggattttgatttgtgtgagggaaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatttcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaagacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagctcagctgataagacaaatggagtctgagggaatattttcacccagcgaattagagaccccaaacttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagagaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5360 - RNA, 9879 nt, synthetic construct
  misc_feature 1..9879: note = derived and/or modified CDS sequence (wt) from DENV-1__GQ868632__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgtcctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcccacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagacttgctggtgacatttaagacagcccatgcaaagaagcaggaagtagtcgtactaggatcacaagaaggagcaatgcacactgcgttgaccggagcaacagaaatccaaacgtctggaacgacaacgatttttgcaggacacttgaaatgcagactaaagatggacaaactgactctaaaaggggtgtcatatgtgatgtgcacaggctcatttaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtgggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgagcaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaagggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtctacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcatttctcaaaaatgatgtgccgctagctgggccactaatagctggaggcatgctaatagcatgttatgttatatctggaagctcagccgacctatcactagagaaagcggctgaggtttcctgggaagaagaagcagaacattctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtgggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtttgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccgatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgatactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacatcacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5361 - RNA, 9879 nt, synthetic construct
  misc_feature 1..9879: note = derived and/or modified CDS sequence (wt) from DENV-1__GQ868633__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagtcactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggactatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcctgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgctatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctatatgggacagcctttaaacaacgatgaagatcacgctcactggacagaagcaaaaatgctccttgataatataaacacaccggaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaagcaaccaaacatgcagtgtcgagaggacccgctaaactgagatggtttgtggagaggaaccttgtgaacccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacagaaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaggagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactgggtcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggtttaaacactttcaccaacatggaagcccagctgataagacaaatggagtctgagggaatcttttcacccagcgaattagagaccccaaacttagccgagagagttctcgactggttggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttggtcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaatcaagtgagaagactaattgggaatgagaattacctagattacatgacatcaatgaagagattcaagaacgagagtgatcccgaaggggcactctggtga

SEQ ID NO: 5362 - RNA, 9879 nt, synthetic construct
  misc_feature 1..9879: note = derived and/or modified CDS sequence (wt) from DENV-1__GU131919__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgttaccactatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgtcctagtgcagattaaatatgaaggaacagatgcaccatgcaagatcccttttttgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttgcgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcatatcagctgtgggccaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctggcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggctataaaaaggaagttgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtattggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtgttctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaatctagatatcattggccagaggatagagaacataaaacatgaacacaagtcaacatggcattatgatgaggacaatccatataaaacatgggcctatcatggatcgtatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctctctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtagaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5363 - RNA, 9879 nt, synthetic construct
  misc_feature 1..9879: note = derived and/or modified CDS sequence (wt) from DENV-1__GU131920__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatggaacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacagagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcctgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaggctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtcccccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcctatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcgctctggtga

SEQ ID NO: 5364 - RNA, 9879 nt, synthetic construct
  misc_feature 1..9879: note = derived and/or modified CDS sequence (wt) from DENV-1__GU131921__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgttaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggcactttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccactatggcaaaagacaaaccaacattggacattgaactcttgaagacggaagtcacaaaccctgccatcctgcgcaaactgtgcatcgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctatgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttaaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctaggattaaactcaaggagcacgtccctttcgatgacgtgcattgcggttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaatttttacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactttatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgattcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggttcaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaaaagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaataacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagtcgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggctttgtgcgaatccatcacactggccaccggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgagaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtagaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaatatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5365 - RNA, 9879 nt, synthetic construct
  misc_feature 1..9879: note = derived and/or modified CDS sequence (wt) from DENV-1__GQ868635__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgttaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggcactttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccactatggcaaaagacaaaccaacattggacattgaactcttgaagacggaagtcacaaaccctgccatcctgcgcaaactgtgcatcgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttaaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctaggattaaactcaaggagcacgtccctttcgatgacgtgcattgcggttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactttatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgattcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggttcaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaaaagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaataacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagtcgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggctttgtgcgaatccatcacactggccaccggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtagagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgagaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtagaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaatatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5366 - RNA, 9879 nt, synthetic construct
  misc_feature 1..9879: note = derived and/or modified CDS sequence (wt) from DENV-1__GQ868636__SS-prME
  source 1..9879: mol_type = other RNA
tctgtgaccatgctacttatgctgatgcccacagccttggcgttccatctgactacacgagggggagagccacatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggctatgcgatgcgtgggaataggcagtagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccctttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctcgtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagggcatggaacatttgggaagttgaggactatggatttggaattttcacgacaaatatatggttgaaattgcgtgactcctacactcaagtgtgtgaccaccggctaatgtcagctgccatcaaggacagcaaggcagtccatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatgggtgttggtacggtatggaaatcagaccagttaaggaaaaggaagagaatctagtcaaatcaatggtctctgcagggttaggggaagtggacagcttttcactaggactgctatgcatatcaataatgatcgaagaggtgatgagatccagatggagtagaaaaatgttgatggctggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttatcaaaacaacgctttccttacaccatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctcgctgggccactaatagctggaggcatgctaatagcatgttatgttatatctggaagctcagccgacttatcattagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcaatttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaaggaaagagactggaaccgagttgggccagcgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaagacaagaagatatctcccagccatagtccgtgaggccataaaaagaaagctgcgcacactaattttggctcccacaagagttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaggacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagtaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactctgggaaagacgtattctttacaccacctgagagatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaaccctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggggggaatatgtatgcagatgacacggccggatgggatacaaggataacggaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcatccaacatacaagtggccataaaccaagtgagaagactaattgggaatgagaattatctagattacatgacatcaatgaagagattcaagaacgagggtgatcccgaaggggcactctggtga

SEQ ID NO: 5367 - RNA, 9879 nt, synthetic construct
  misc_feature 1..9879: note = derived and/or modified CDS sequence (wt) from DENV-1__GU131922__SS-prME
  source 1..9879: mol_type = other RNA
tctgtgatcatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaagtcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggctagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgatctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggttttgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgaaaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctacaaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggctgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagaaagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaactagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5368 - RNA, 9879 nt, synthetic construct
  misc_feature 1..9879: note = derived and/or modified CDS sequence (wt) from DENV-1__GU131923__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagatgcgaactttgtgtgtcgacgaacggttgtggacagaggctggggcaatggctgtgggctctttggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcctcaacatcacaagagacttggaacagacaagacttgctggtgacatttaagacagctcatgcaaagaagcaggaagttgtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggaataacccagaatgggagattgataacagctaaccccatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtattggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcaggaccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtctttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgttcctcatagcagaaaacaaaatctggggaaagagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcaaagaggactgttgggcaggtcccaagtaggggtaggagttttccaagaaaacgtgttccacacaatgtggcatgttaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatacctaccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcctaattacaacatgattatcatggatgaagcacatttcaccgatccatccagtatagcggccagagggtacatttcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactagagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgaggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacactacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacgagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5369 - RNA, 9879 nt, synthetic construct
  misc_feature 1..9879: note = derived and/or modified CDS sequence (wt) from DENV-1__GQ868637__SS-prME
  source 1..9879: mol_type = other RNA
tctgtgaccatgctccttatgctgatgcctacagccttggcgttccatttgactacacgaggaggagagccgcacatgatagttagcaagcaggaaagaggaaagtcacttttgttcaagacctcagcaggtgtcaacatgtgcacccttatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgagggcgcttggaaacagatacaaagagtggagacttgggccctgagacacccaggattcacggtgatagccctttttctagcacatgccataggaacatccatcacccagaaagggattattttcattttgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcttgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaaccgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatattcgtggaaaagctggggaaaagctaaaatcataggggcagatgtacagaacaccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccggtcaaggaaagggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatttgatcaggttatgcatcatggttggagccaacgcttccgacaggatggggatgggaacgacgtacctagctttgatggctacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcacatcagctgtgggctaccctgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaatgtgttccacacaatgtggcatgtcaccaggggagctgtactcatgtatcaagggaagagactggaaccgagttgggccagtgtcaaaaaagacctgatctcatatggaggaggttggaggctccaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcctatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgaccttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctggacgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagagctgccagacactatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaagtgaatccactgacgctgatagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggataatggaagtggacagatccgaagccaaagagggactaagaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacatgtgtttacaacatgatggggaagagagagaaaaaactaggagagttcggaaaggcaaaaggaagtcgtgcaatatggtacatgtggctgggagcacgctttctagagttcgaagctcttggttttatgaacgaagatcactggttcagcagagagaattcactcagcggagtggaaggagaaggactccacaaactcggatatatactcagagacatatcaaagattcctgggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacctagcgaattggagaccccaaatttagccgagagagttctcgactggctggaaaaatatggcgtcgaaaggctgaaaagaatggcaatcagcggagatgactgcgtggtgaaaccaattgatgacaggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctaagagaaactgcatgcctaggcaagtcatatgcacaaatgtggcaactgatgtacttccacaggagagacctgagactagccgctaatgctatctgttcagccgttccagttgattgggtcccaaccagccgcaccacctggtcgatccatgcccatcaccaatggatgacaacagaagatatgttgtcagtgtggaatagggtttggatagatgaaaacccatggatggaggacaaaacccatatatccagttggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactatggtga

SEQ ID NO: 5370 - RNA, 9879 nt, synthetic construct
  misc_feature 1..9879: note = derived and/or modified CDS sequence (wt) from DENV-1__GQ868639__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaatttacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattggctgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagcggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcagcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5371 - RNA, 9879 nt, synthetic construct
  misc_feature 1..9879: note = derived and/or modified CDS sequence (wt) from DENV-1__GU131925__SS-prME
  source 1..9879: mol_type = other RNA
tctgtgaccatgctccttatgctgatgcctacagccttggcattccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatattgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagcagccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgttaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgaggggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5372 - RNA, 9879 nt, synthetic construct
  misc_feature 1..9879: note = derived and/or modified CDS sequence (wt) from DENV-1__GU131926__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggagtaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagttaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgcgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagcggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcagcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccacaaacatacaagtggccataaaccaagtgagaaggctaattgggaatgagaattatctagattacatgacatcaatgaagagattcaagaacgagagtgatcctgaaggggcactctggtga

SEQ ID NO: 5373 - RNA, 9879 nt, synthetic construct
  misc_feature 1..9879: note = derived and/or modified CDS sequence (wt) from DENV-1__FJ639669__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgtacagaacaccaccttcatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5374 - RNA, 9882 nt, synthetic construct
  misc_feature 1..9882: note = derived and/or modified CDS sequence (wt) from DENV-1__FJ639670__SS-prME
  source 1..9882: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagcaaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgccaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagatctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgcacagaacaccaccttcatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtagagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtattctgacagaagatggtgctttgacggggaaaggaacaaccaggtgttggaggagaacatggacgtggagatctggacaaaagaaggagtctcaagaaagaacctacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatagccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgttggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaaggcagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctcttcaaacccaactatagaggaaggaagaacgctacgcgtcctaaagatggtggaaccatggctcagaggaaaccaattttgcataaaaattctgaatccctacatgccaagtgtggtggaaactctggagcaaatgcaaaggaaacatggaggaatgctagtgcgaaatccactttcaagaaattctacccatgaaatgtattgggtttcatgtggaacaggaaacattgtgtcagcagtgaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacggtttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5375 - RNA, 9879 nt, synthetic construct
  misc_feature 1..9879: note = derived and/or modified CDS sequence (wt) from DENV-1__FJ639671__SS-prME
  source 1..9879: mol_type = other RNA
tctgtgaccatgctccttatgctgatgcctacagccttggcgttccatttgactacacgaggaggagagccgcacatgatagttagcaagcaggaaagaggaaagtcacttttgttcaagacctcagcaggtgtcaacatgtgcacccttatagcgatggacttgggagagttatgtgaggacacattgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccctggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatggaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaaccgccagaggagcacgaaggatggccatactgggagacaccgcatgggactttggttctgtaggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatgtcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgacggcccaaacacctcagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcagggcagttcacgctgatatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaaccgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtgggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaagaaccccaaaaatgtacaaacagcgccgggcaccttcaagacccctgaaggtgaagttggagccattgccctagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacatacaggaagagagatagttgaccttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggagaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgttatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgacctcgctggctggatgccagaacatactcagacccactggccctgcgcgagttcaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagagactatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggaggggtctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggataatggaagtggacagatccgaagccaaagagggactaagaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctaaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatacgaaagagacgtggacctaggtgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtattcgttgatgaaaatcaatggaactcagcaaaagaagcagtggaagatgagcggttctgggaccttgtgcacagagagagggagcttcacaaacagggaaaatgcgccacgtgtgtttacaacatgatggggaaaagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacacgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctgaaaagaatggcaatcagcggagatgactgcgtggtgaaaccaattgatgacaggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgcaccacctggtcgatccatgcccatcaccaatggatgacaacagaagacatgttgtcagtgtggaatagggtttggatagaggaaaacccatggatggaggacaaaacccatatatccagttggggagatgttccatatttagggaaaagggaagatcagtggtgtggatccctgataggcttaacagcaagggccacctgggccaccaacatacaagtggccataaaccaagtgagaagactaattgggaatgaaaactacttagattacatgacatcaatgaagagattcaagaacgagagtgatcccgaaggggcactctggtga

SEQ ID NO: 5376 - RNA, 9879 nt, synthetic construct
  misc_feature 1..9879: note = derived and/or modified CDS sequence (wt) from DENV-1__JN819423__SS-prME
  source 1..9879: mol_type = other RNA
tctgtgaccatgctccttatgctgatgcctacagccttggcgttccatttgactacacgaggaggagagccgcacatgatagttagcaagcaggaaagaggaaagtcacttttgttcaagacctcagcaggtgtcaacatgtgcacccttatagcgatggacttgggagagttatgtgaggacacattgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccctggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatggaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaaccgccagaggagcacgaaggatggccatactgggagacaccgcatgggactttggttctgtaggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatgtcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgacggcccaaacacctcagaatgccctgatgatcaaagagcatggaacatttgggaagttgaggactatggatttggaattttcacgacaaacatatggctgaaattgcgtgactcctacacccaagtgtgtgaccaccgactaatgtcagctgccatcaaggacagcagggcagttcacgctgatatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaattacagaccaggatatttcacacaaacggcagggccgtggcacctaggcaagttggaactggattttgatttgtgtgagggtaccacagttgttgtggatgaacattgtggaaaccgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtgggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaagaaccccaaaaatgtacaaacagcgccgggcaccttcaagacccctgaaggtgaagttggagccattgccctagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacatacaggaagagagatagttgaccttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggagaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgttatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgacctcgctggctggatgccagaacatactcagacccactggccctgcgcgagttcaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagagactatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggactcgacaaaggatggccaatatcgaagatggacataggagttccacttctcgccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggaggggtctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggataatggaagtggacagatccgaagccaaagagggactaagaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctaaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatacgaaagagacgtggacctaggtgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtattcgttgatgaaaatcaatggaactcagcaaaagaagcagtggaagatgagcggttctgggaccttgtgcacagagagagggagcttcacaaacagggaaaatgcgccacgtgtgtttacaacatgatggggaaaagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacacgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctgaaaagaatggcaatcagcggagatgactgcgtggtgaaaccaattgatgacaggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgcaccacctggtcgatccatgcccatcagcaatggatgacaacagaagacatgttgtcagtgtggaatagggtttggatagaggaaaacccatggatggaggacaaaacccatatatccagttggggagatgttccatatttagggaaaagggaagatcagtggtgtggatccctgataggcttaacagcaagggccacctgggccaccaacatacaagtggccataaaccaagtgagaagactaattgggaatgaaaactacttagattacatgacatcaatgaagagattcaagaacgagagtgatcccgaaggggcactctggtga

SEQ ID NO: 5377 - RNA, 9879 nt, synthetic construct
  misc_feature 1..9879: note = derived and/or modified CDS sequence (wt) from DENV-1__FJ639672__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataagcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagccgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgtacagaacaccaccttcatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggagtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaagccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgcttcgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggatagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgcattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagcgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcgacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcagcagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5378 - RNA, 9879 nt, synthetic construct
  misc_feature 1..9879: note = derived and/or modified CDS sequence (wt) from DENV-1__FJ639673__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgtcaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaacgagacctggaagttggcaagagcctcttttatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgtggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaagacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgaccttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccaaaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggcggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattcccaagtgaatccactgacgctgacagcggcggtactgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctgggcatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtgagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggcagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5379 - RNA, 9879 nt, synthetic construct
  misc_feature 1..9879: note = derived and/or modified CDS sequence (wt) from DENV-1__FJ639674__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcatgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggaattaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtgctgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagtagacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagtaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5380 - RNA, 9879 nt, synthetic construct
  misc_feature 1..9879: note = derived and/or modified CDS sequence (wt) from DENV-1__FJ639675__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatcactgaggcagaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggcttattcaagctagagaaagaagtggctgagacccagcatggaaccgttctagtgcagattaaatatgaaggaacagatgcaccatgcaagatccctttttcgacccaagatgaaaaaggagtaactcagaatgggagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacatcagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcatcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaattttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcttccttctcataatgggacaattgacatggaatgatctgatcagattatgcatcatggttggagccaacgcttccgacaggatggggatgggaatgacgtacctagctctgatggccacttttaaaatgagaccaatgtttgctgtaggactattattccgcagactaacatccagagaagttcttcttctaacaattggattgagtctagtggcatccgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgactctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaagaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcccttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcgaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaatcttttcacccagcgaattagagaccccaaatttagccgagagagttctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcagtggtgtggatccctgataggcttaacagcaagggccacctgggccactaacatacaagtggccataaaccaagtgagaagactaattgggaatgagaactatctagattacatgacatcaatgaagagattcaagaacgagagtgatcctgaaggggcactctggtga

SEQ ID NO: 5381 - RNA, 9879 nt, synthetic construct
  misc_feature 1..9879: note = derived and/or modified CDS sequence (wt) from DENV-1__FJ639676__SS-prME
  source 1..9879: mol_type = other RNA
tctgtgaccatgctccttatgctgatgcctacagccttggcgttccatttgactacacgaggaggagagccgcacatgatagttagcaagcaggaaagaggaaagtcacttttgttcaagacctcagcaggtgtcaacatgtgcacccttatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgcgggacttggtttagaaacaagagccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgccgacgaacgtttgtggacagaggctggggcaatggctgtgggctcttcggaaaaggaagcttgataacgtgtgctaagttcaagtgtgtgacaaaactggaaggaaagatagttcaatatgaaaacttgaaatattcagtaatagtcaccgtccacactggggaccagcaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaagaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtgacccagaatgggagattgataacagcgaaccccatagtcaccgacaaagaaaaaccagtcaacattgaggcagaaccgccttttggtgagagttacatcgtgattggagcaggtgaaaaagctttgaagctaagctggttcaagaaaggaagcagcatagggaaaatgtttgaggcaaccgccagaggagcacgaaggatggccatactgggagacaccgcatgggactttggttctataggaggagtgttcacgtctgttggaaaactagtacaccagatttttggaacagcatatggagttttgttcagcggtgtttcctggaccatgaaaataggaataggggttctgctgacatggctaggattaaactcaaggagcacgtccctttcgatgacgtgcattgcagttgggctagtaacactatacctaggagtcatggttcaggcagattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggcccaaggaaaaaagatgattaggccacaacccatggaacacaaatactcatggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgcacgttaccacccctacgttttaaaggagaagatgggtgttggtacggtatggaaatcagaccagtcaaggaaaaggaagagaatctagtcaagtcaatggtctctgcagggtcaggggaagtggacagcttttcactaggactgttatgcatatcaataatgatcgaagaggtgatgagatccagatggagtaggaaaatgctgatgactggaacactggctgtgttcttccttctcatagtgggacaattaacatggaatgatctgatcaggttatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattgttgactgactttcagtcatatcagctgtgggctaccttgctgtccttgacatttatcaaaacgacgttttccttgcactatgcatggaagacaatggctatggtactgtcaattgtatctctcctccccttatgcctgtccacgacctcccaaaagacaacatggcttccggtgctattgggatctcttggatgcaaaccactaactatgttttttatagcagaaaacaaaatctggggaaggaaaagttggcccctcaatgaaggaatcatggctgttggcatagtcagtatcctactaagttcactcctcaaaaatgatgtgccgctagctgggccactaatagctggaggcatgctaatagcatgttatgttatatcaggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttctgaaatggcagaggcgctcaaggggatgccaataaggtaccaaacaacagcagtgaagagtgaacacacaggaagagagatagttgaccttatgtgtcacgccactttcaccatgcgtctcctgtctcctgtgagagttcccaattacaacatgattatcatggatgaagctcatttcaccgatccatccagcatagcggccagaggatacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagagaagagtgcagcaatagacggggaatacagactgcggggtgaagcaaggaaaacgtttgtggagctcatgagaagaggagatttacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctggatgccagaacatattcagacccactggccctgcgcgagtttaaagagtttgcagcaggaagaagaagcatctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttaactggtggagtgacgctgttcttcctatcaggaaggggcctagggaaaacatctataggcctactctgcgtgatggcttcaagtgcactgctatggatggccagtgtggagccccattggatagctgcctccatcatactggagttcttcctgatggtgctgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaggtgaatccactgacgctgacagcggcggtactgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatattggaagtggacagatccgaagccaaagagggactaagaagaggagaaacaaccaaacacgcggtgtcgagaggaactgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctgaaaagaatggcaatcagcggagatgactgcgtggtgaaaccaattgatgacaggtttgcgacagccttaacagctctgaatgatatgggaaaagtaagaaaagatattccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcttgagagaaactgcatgcctaggcaagtcatatgcacaaatgtggcaactgatgtacttccacaggagagacctgagactagccgctaatgctatctgttcagccgttccagttgattgggtcccaaccagccgcaccacctggtcgatccatgcccatcaccaatggatgacaacagaagacatgttgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccaccaacatacaagtggccataaaccaagtgagaagactaattgggaatgagaattatttagatttcatgacatcaatgaagagattcaagaacgagagtgataccgaaggggcactctggtga

SEQ ID NO: 5382 - RNA, 9879 nt, synthetic construct
  misc_feature 1..9879: note = derived and/or modified CDS sequence (wt) from DENV-1__FJ639677__SS-prME
  source 1..9879: mol_type = other RNA
tccgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgagtcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctatggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttaaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtaaagagtgaacacacaggaaaagagatagttgacctcatgtgtcacgccactttcaccatgcgcctcctgtctcccgtgagagttcccaattacaacatgattatcatggatgaagcacattttaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcgaggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaagcaagaaaccaagaatttgtacaagagaggagttcataagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5383 - RNA, 9879 nt, synthetic construct
  misc_feature 1..9879: note = derived and/or modified CDS sequence (wt) from DENV-1__GQ868618__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatcactgaggcggaaccagatgacgttgattgttggtgcaatgccacagacacatgggtgacttatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatctatcacccagaaagggattattttcattttgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattagacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactgataacagctaaccctatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattggtacaccagatttttggaactgcatatggagttttgttcagcggtgtttcctggaccatgaaaataggaataggggttctgctgacatggttaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaatttacagtggttgtaggagatgttgctggaatcttggctcaagggaaaaaaatgattaggccacaacccatggaatacaaatactcgtggaaaagctggggaaaggctaaaatcataggggcagatgtgcagaatactaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacttaggcaagttggaactggattttgatttgtgtgagggtaccacagttgttgtggatgaacattgtggaaatcgaggaccatctcttaggaccacaacagtcacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctccgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacatcgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgttggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggccttctctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaattgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagagacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagctaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaatcttttcacccagcgaattagagaccccaaatttagccgagagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaagatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcatcaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5384 - RNA, 9879 nt, synthetic construct
  misc_feature 1..9879: note = derived and/or modified CDS sequence (wt) from DENV-1__GQ868619__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgccaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgcacagaacaccaccttcatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggagagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggttgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagattaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgctatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacccctgaaggcgaagttggagccattgccctagattttaaacccggcacatctggatctcccatcgtgaacagagaaggaaaaatagtgggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcaatggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccgataatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttaatgctcctagctttgatagctgtgttaactggtggagtgatgctgttcttcctatcaggaaggggcctagggaaaacatctatcggcctactctgcgtgatggcttcaagcggactgctatggatggccagtgtggagccccattggatagcggcctccatcatactggagttcttcctgatggtgctgcttattccagagccagacagacaacgcactccgcaggacaaccagctggcatatgtggtgatgggtttgttattcatgatactgacagtagcagccaatgagatgggactgctggaaaccacaaagaaagacttagggattggccatgtggctgttgaaaatcaccaccatgccgcaatgttggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaaggcagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaaggaaacatggaggaatgctagtgcgaaatccactttcaagaaattctacccatgaaatgtactgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacggtttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggctaccaacatacaagtggctataaaccaagtgagaagactaattgggaatgagaattatctagattacatgacatcaatgaagagattcaagaacgagagtgatcccgaaggggcactctggtga

SEQ ID NO: 5385 - RNA, 9879 nt, synthetic construct
  misc_feature 1..9879: note = derived and/or modified CDS sequence (wt) from DENV-1__FJ639678__SS-prME
  source 1..9879: mol_type = other RNA
tctgtgaccatgctccttatgctgatgcctacagccttggcgttccatttgactacacgaggaggagagccgcacatgatagttagcaagcaggaaagaggaaaggcacttttgtttaagacctcagcaggtgtcaacatgtgcacccttatagcaatggatttgggagagttatgtgaggacacaatgacttacaagtgtcctcgaattactgaggtggaaccagatgacgttgattgttggtgcaatgccacagacacatgggtgacctatggaacatgcccccaaactggcgagcaccgacgagacagacgttccgttgcactggccccacatgtgggacttggtttggaaacaagagccgaaacgtggatgtcctctgaaggcgcttggaaacagatacaaagagtggagacttgggccctgagacacccgggattcacggtgatagccctttttctagcacatgccataggaacatccattacccagaaagggattattttcattttgttaatgctggtaacaccttccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaataccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaaccgcaactataacacctcaagctcctacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccctggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcagggcacctgaaatgtagactaaagatggacaaactgactctaaaagggatgtcatatgtgatgtgcacaggatcgtttaagctagagaaagaagtggctgagacccagcatggaaccgttctagtgcagattaaatacgaaggaacagatgcaccatgcaagatccccttttcgacccaagatgaaaaaggagtaacccagaatgggagattgataacagctaaccctatagtcactgacaaagaaaaaccagtcaacattgaggcagaaccgccttttggtgagagttacatcgtgataggagcaggtgaaaaagctttgaaactaagctggttcaagaaaggaagcagcataggaaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctagggttaaactcaaggagcacgtctctttcgatgacgtgcattgcagttggtctagtaacactatacctaggagtcatggttcaggcggattcaggatgtgtaatcaattggaaaggtagagaactcaaatgtggaagtggcatttttgtcaccaatgaagttcacacttggacagaacaatacaaatttcaagctgactccccaaagagactatcagcagccatcgggaaggcatgggaggagggtgtgtgtggaattcgatcagccacccgtctcgagaatatcatgtggaagcaaatatcaaatgaactgaaccacatcttacttgaaaatgacatgaaattcacagtggttgtaggagatgttgttgggatcttggctcaagggaaaaagatgattaggccacaacccatggaatacaaatactcgtggaaaagctggggaaaggcaaagatcataggggcagatatacagaacaccaccttcatcatcgacggcccaaacaccccagaatgccctgatgatcaaagagcgtggaacatttgggaagttgaggactatggatttggaattttcacgacaaacatatggctgaaattgcgtgactcctacacccaagtgtgtgaccaccggctgatgtcagctgccatcaaggacagcaaggcagttcacgctgatatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatagaggaccatctcttagaaccacaacagtcacaggaaagataattcatgaatggtgttgcagatcttgtacgctaccacccttacgtttcaaaggagaagatgggtgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcttccgacaggatggggatgggaacgacgtacctagctctgatggccacttttaaaatgagaccaatgtttgctgtcgggctattattccgcagactaacatccagagaagttcttcttctaacaattggattgagtctagtggcatctgtggagttaccaaattccttagaggagctgggggatggacttgcaatgggcattatgatcttaaaattattgactgactttcagtcacatcagctgtgggccaccttgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatctgggggaggaaaagttggcccctcaatgaaggaatcatggctgttggaatagtcagcatcctactaagttcactcctcaaaaatgatgtgccgctagctgggccactaatagctggaggcatgctaatagcatgttatgttatatcaggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctggcagtttcaggagtgtacccattatcaataccagcgaccctttttttgtggtacttttggcagaaaaagaaacagagatctggagtgttatgggacacacctagccctccagaagtcgaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagaggctggaaccgagttgggccagtgtcaaaaaagatctgatctcatatggaggaggttggaggcttcaaggatcctggaacacgggagaagaagtgcaggtgattgccgttgaaccagggaaaaaccccaaaaatgtacaaacagcgccgggcacctttaagacccctgagggtgaagttggagccattgccctagattttaaacccggcacatctggatctcccatcgtgaacagagaagggaaaatagtaggtctatatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctctctcctgtgagagttcccaactacaacatgattatcatggatgaagcacatttcaccgatccatccagcatagcggccagaggatacatctcaacccgagtgggcatgggtgaagcagctgcgatcttcatgacagccactcccccaggatcagtggaggcctttccacagagcaatgcagttatccaagatgaggaaagagacattcctgagaggtcatggaactcaggctatgagtggatcactgacttcccaggtaaaacagtttggtttgttccaagcattaaatcaggaaatgacattgccaattgcttaagaaagaatgggaaacgggtgattcaattgagcaggaaaacctttgatacagagtaccaaaaaacaaaaaataacgactgggactacgttgtcacaacagacatctccgaaatgggagcaaacttccgggccgacagggtgatagacccaagacggtgtctgaaaccggtaatactaaaagatggtcaagagcgtgtcattttagcaggaccgatgccagtgactgtggccagtgccgcccagaggagaggaagaattggaaggaaccacaataaggaaggtgatcagtacatctacatgggacagcctttaaacaacgatgaggatcacgcccactggacagaagcaaaaatgctccttgataatataaacacaccagaagggattatcccagccctcttcgaaccggagagagaaaaaagtgcagcaatagacggggaatacagactgcggggtgaagcaaggaaaacgttcgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaaaggcccagaatgccttggacaacctggtcatgttgcacaactccgaacaaggaggaagagcctatagacatgcaatggaagaactgccagacaccatagaaacgttgatgctcctagccttgatagctgtgttaactggtggagtgacgctgttcttcctatcaggaaggggcctagggaaaacatctatcggcctactctgcgtgatggcttcaagcgcactgctatggatggccagtgtagagccccattggatagcggcctccatcatactggagttcttcctgatggtgctgcttattccagagccagacagacaacgcactccgcaggacaaccagctggcatatgtggtgataggtttgttatttatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaagtgaatccactgacgctgacagcagcggtattgatgctagtggctcattacgccataattggacctggactacaagcaaaagctactagagaagctcaaaaaaggacagcagccggaataatgaaaaacccgaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcagtctccatggcaaacattttcagaggaagttatctagcaggagcaggtctggccttctcattaatgaaatctctaggaggaggtaggagaggcacgggagcccaaggagaaacattgggagagaaatggaaaagacagctgaaccaactgagcaagtcagaattcaacacttacaaaaggagtgggataatggaagtagatagatccgaagccaaagagggactaaaaagaggagaaacaaccagacatgcagtgtcgagaggaaccgccaaactaaggtggtttgtggagaggaacctcgtgaaaccagaagggaaagttatagacctcggttgtggaaggggtggttggtcatactattgcgctgggctgaagaaagtcacagaagtgaagggatacacaaaaggaggacctggacatgaggaaccaatcccaatggcaacctatggatggaacctagtaaagctgcactccgggaaagacgtattcttcataccacctgagaaatgtgacacccttttatgtgatattggtgagtcctctccaaacccaactatagaggaaggaagaacgttacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaacccactttcaagaaattctactcatgaaatgtattgggtttcatgtggaacaggaaacattgtgtcagcagtaaacatgacatctagaatgttgctaaatcgattcacaatggctcacagaaaaccaacatatgaaagagacgtggacctaggcgccgggacaagacacgtggcagtggaaccagaggtagccaacctggacatcattggccagaggatagagaacataaaacatgaacataagtcaacatggcattatgatgaggacaatccatataaaacatgggcctatcatggatcatatgaagtcaagccatcaggatcagcctcatccatggtcaatggcgtggtgaaattgctcaccaaaccatgggatgtcatccccatggtcacacaaatagccatgactgacactacaccctttggacaacagagggtgtttaaagagaaagttgacacacgcacaccaaaagcaaaacaaggcacagcacaaatcatggaggtgacagccaggtggttatggggttttctttctagaaacaaaaaaccaagaatttgtacaagagaggagttcacaagaaaagttaggtcaaacgcagccattggagcagtgttcgttgatgaaaatcaatggaactcagcaaaagaagcagtggaagatgaacggttctgggatcttgtgcacagagagagggagcttcataaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactacacaaactcggatatatactcagagacatatcaaagattcctgggggaaacatgtatgcagatgacacagccggatgggatacaaggataacagaggatgaccttcggaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctaataagacaaatggagtctgagggaatcttttcacccagcgaattggagaccccaaatttagccgagagagttctcgactggctggaaaaatatggcgtcgaaaggctgaaaagaatggcaatcagcggagatgactgcgtggtgaaaccaattgatgacaggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcttgagagaaactgcatgcctaggcaagtcatatgcacaaatgtggcaactgatgtacttccacaggagagacctgagactagccgccaatgctatctgttcagccgttccagttgattgggtcccaaccagccgcaccacctggtcgatccatgcccatcaccaatggatgacaacggaagacatgttgtcagtgtggaacagggtttggatagaggaaaacccatggatggaggacaaaacccatatatccagttgggaagatgttccatacttaggaaaaagggaagatcagtggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5386 - RNA, 9879 nt, synthetic construct
  misc_feature 1..9879: note = derived and/or modified CDS sequence (wt) from DENV-1__FJ639679__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggtaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgctgtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtactgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgcgagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5387 - RNA, 9879 nt, synthetic construct
  misc_feature 1..9879: note = derived and/or modified CDS sequence (wt) from DENV-1__FJ850069__SS-prME
  source 1..9879: mol_type = other RNA
tctgtgaccatgctccttatgctgatgcctacagccttggcgttccatttgactacacgaggaggagagccgcacatgatagttggcaagcaggaaagaggaaagtcacttttgttcaagacctcagcaggtgtcaacatgtgcacccttatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggggaccagcaccaggtgggaaatgaaagcacagaacatgggacaactgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatatgaaggaacagacgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgattggagcaggtgaaaaagctttgaagctaagctggttcaagaaaggaagcagcatagggaaaatgtttgaggcaaccgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttttgctgacatggctaggattaaactcaaggagcacgtccctttcgatgacgtgcattgcagttggtctagtaacactatacctaggagtcatggttcaggcagattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatccgccacccgtctcgagaatatcatgtggaggcaaatatcaaatgaactgaaccacatcttacttgaaaatgacatgaaattcacagtagttgtaggagatgttgttgggatcttggcccaaggaaaaaagatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctgatgtcagctgccatcaaggacagcaaggcagttcacgctgatatggggtactggatagaaagtgaaaagaacgagacctggaagctagcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcacgaatggtgttgcagatcttgcacgttaccacccttacgttttaaaggagaagatgggtgctggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggttaccttgctgtccttgacatttatcaaaacaacgttttccttgcactatgcatggaagacaatggctatggtactgtcaattgtatccctcctccccttatgcctgtccacgacctcccaaaagacaacatggcttccggtgctattgggatctcttggatgcaaaccactaactatgttttttatagcagaaaacaaaatctggggaaggaaaagttggcccctcaatgaaggaatcatggctgttggcatagtcagtatcctactaagttcactcctcaaaaatgatgtgccgctagctgggccactaatagctggaggcatgctaatagcatgttatgttatatcaggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactttgctagcagtttcaggggtgtacccattatcaataccagcgaccctttttgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggttctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgaccttatgtgtcacgccactttcaccatgcgtctcctgtctcctgtgagagttcccaattacaacatgattatcatggatgaagcacatttcactgatccatccagcatagcggccagaggatacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcctaagaaagaatgggaaacgggtgattcaattgagcagaaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcattttagcaggaccgatgccagtgactgtggccagtgccgcccagaggagaggaagaatcggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggctttcagtactccgacagaagatggtgctttgacggggaaaggaacaaccaggtgttggaggagaacatggacgtggagatctggacaaaagaaggagaaagaaagaaactacgaccccgctggctggatgccagaacatattcagacccactggccctacgcgagtttaaagagtttgcagcaggaagaagaagcatctcaggtgatttaatattagaaatagggaaacttccacaacacttgacgcaaagggcccagaatgccttggataacctggtcatgttgcacaactccgaacaaggaggaagagcctatagacatgcaatggaagaactgccagacactatagaaacgttgatgctcctagctttgatagctgtgttaactggtggagtgacgctgttcttcctatcaggaaggggcctagggaaaacatctatcggcctactctgcgtgatggcttcaagtgcactgctatggatggccagtgtggagccccattggatagcggcctccatcatactggagttcttcctgatggtgttgcttattccagagccagacagacaacgcactccgcaagacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctaacagctattgcgaaccaggcagctatattgatgggacttgataaaggatggccaatatcgaagatggacataggagttccacttctcgccttggggtgctattcccaagtgaatccactgacgctgacagcggcggtattgatgctagtggctcattacgccataattggacctggactgcaagcaaaagctactagagaagcccaaaaaagaacagcggccggaataatgaaaaatccaaccgttgatggaattgttgcaatagatttggatcctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatattggaagtggacagatccgaagccaaagagggactaagaagaggagaaacaaccaaacatgcggtgtcgagaggaactgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccgggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggttttatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctgaaaagaatggcaatcagcggagatgactgcgtggtgaaaccaattgatgacaggtttgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgcaccacctggtcgatccatgcccatcaccaatggatgacaacagaagacatgttgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgataccgaaggggcactctggtga

SEQ ID NO: 5388 - RNA, 9879 nt, synthetic construct
  misc_feature 1..9879: note = derived and/or modified CDS sequence (wt) from DENV-1__FJ639680__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggaaggtgtgtgtggaattcgatcagcaactcgtctcgagaacatcatgtggaaacaaatatcaaatgaattgaaccacatcttacttgaaaatgacatgaaactcacagtggttgtaggagatgttgctgggatcttggctcaaggaaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctctccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaatttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgttacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcgaggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatattgacagtagcagccaatgagatgggactgctagaaaccacaaagaaagacttagggattggccatgtggctgttgaaaatcacaaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgaccgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgactgcgtagtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5389 - RNA, 9879 nt, synthetic construct
  misc_feature 1..9879: note = derived and/or modified CDS sequence (wt) from DENV-1__FJ639682__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgaacaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctggagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcgggtgaaaaaactttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctactgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggaaggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccatcggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagtaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtatggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttttatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaatttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatcccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttaccgatccatccagcatagcggccagagggtacatctcaacccgagtgggcatgggtgaagcagccgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagatccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcgaggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccctggacaacctggttatgctgcacaattccgaacaaggaggaagagcctatagacatgcaatggaagaattgccagacaccatagaaacgttaatgctcctagccttgatagctgtgttaactggtggagtgacgctgttcttcctatcaggaaggggcctagggaaaacatctatcggcctactctgcgtgatggcttcaagcgtactgctatggatggccagcgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctagaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcttaaagatggtggaaccatggctcagaggaaaccaattttgcataaaaattctgaatccctacatgccaagtgtggtggaaactctggagcaaatgcaaagaaaacatggaggaatgctagtgcgaaatcccctttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgactgtgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5390 - RNA, 9879 nt, synthetic construct
  misc_feature 1..9879: note = derived and/or modified CDS sequence (wt) from DENV-1__JQ287664__SS-prME
  source 1..9879: mol_type = other RNA
tctgtgaccatgctccttatgctgatgcctacagccttggcgttccatttaactacacgaggaggagagccgcacatgatagttagcaagcaggaaagaggaaagtcacttttgttcaagacctcagcaggtgtcaacatgtgcacccttatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacatcgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggggaccagcaccaggtgggaaatgaaagcacagaacatgggacaaccgcaactataacacctcaagctcctacgtcggaaatacagctgaccgactacggagctcttacattggattgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgtaagatccctttttcgacccaagatgaaaaaggagtaacccagaatgggagattgataacagctaaccccatagtcaccgacaaagaaaaaccagtcaacattgaggcagaaccgccttttggtgagagttacatcgtgattggagcaggtgaaaaagctttgaagctaagctggttcaagaaaggaagcagcatagggaaaatgtttgaggcaaccgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcagattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccattaaggacagcaaggcagttcacgctgatatggggtactggatagaaagtgaaaagaacgagacctggaagctggcaagagcctctttcatagaagttaaaacatgtatctggccaaaatcccacaccctatggagcaacggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataatccatgaatggtgttgcagatcttgcacgttaccacccttacgttttaaaggagaagatgggtgttggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattgttgactgactttcagtcatatcagctgtgggctaccttgctatccttgacatttatcaaaacaacgttttccttgcactatgcatggaagacaatggctatggtactgtcaattgtatcgctcctccccttatgcctgtccacgacctcccaaaagacaacatggcttccggtactactgggatctcttggatgcaaaccactaaccatgttttttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctgatagcatgttatgttatatcaggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaaaatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgaccttatgtgtcacgccactttcaccatgcgtctcctgtctcctgtgagagttcccaattacaacatgattatcatggatgaagctcatttcaccgatccatccagcatagcggccagaggatacatttcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggcaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataacataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtattccgacagaagatggtgctttgacggggaaaggaacaaccaggtgttggaggagaacatggacgtggagatctggacaaaagaaggagaaagaaagaaactacgaccccgctggctggatgccagaacatattcagacccactggccctgcgcgagtttaaagagtttgcagcaggaagaagaagcatctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttaactggtggagtgacgctgttcttcctatcaggaaggggcctagggaaaacatctatcggcttactttgcgtgatggcttcaagtgcactgctatggatggctagtgtggagccccattggatagcggcctccatcatactggagttctttctgatggtgctgcttattccagagccagacagacaacgcactccgcaagacaaccagctggcatatgtggtgataggtttgttattcatgatactgacagtagcagccaatgagatgggattactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatattggaagtggacagatccgaagccaaagagggactaagaagaggagaaacaaccaaacatgcggtgtcgagaggaactgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagttgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggttacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctgaaaagaatggcaatcagcggagatgactgcgtggtgaaaccaattgatgacaggtttgcgacagccttaacagctctgaatgatatgggaaaagtaagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccatttgattgggtcccaaccagccgcaccacctggtcgatccatgcccatcaccaatggatgacaacagaagacatgttgtcagtgtggaatagggtttggatagaggaaaacccatggatggaggacaaaacccatatatccagttgggaagatgttccatatttaggaaaaagggaagatcagtggtgtggatctctgataggcttaacagcaagggccacctgggccaccaacatacaagtggccataaaccaagtgagaagattaattgggaatgagaattatttagattacatgacatcaatgaagagatttaagaacgagagtgataccgaaggggcactctggtga

SEQ ID NO: 5391 - RNA, 9879 nt, synthetic construct
  misc_feature 1..9879: note = derived and/or modified CDS sequence (wt) from DENV-1__FJ639683__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcattggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggctatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcattggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttgccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggccatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5392 - RNA, 9879 nt, synthetic construct
  misc_feature 1..9879: note = derived and/or modified CDS sequence (wt) from DENV-1__FJ639684__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaaggaaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgaaggaatcttttcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccactaacatacaagtggccataaaccaagtgagaaggctaattgggaatgagaattatctagattacatgacatcaatgaagagattcaagaacgagagtgttcctgaaggggcactctggtga

SEQ ID NO: 5393 - RNA, 9879 nt, synthetic construct
  misc_feature 1..9879: note = derived and/or modified CDS sequence (wt) from DENV-1__FJ639685__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacctacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaattcaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagtcactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacctggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagttaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcagtaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaattttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaactagtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtatggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcgatgaagagattcaagaacgagagtgatcccgaaggggcactctggtga

SEQ ID NO: 5394 - RNA, 9879 nt, synthetic construct
  misc_feature 1..9879: note = derived and/or modified CDS sequence (wt) from DENV-1__FJ639686__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactttaaaagggatgtcatatgtgatgtgcacaggctcattcaagctagagaaagaagtggctgagacccagcatggaaccgttctagtgcagattagatatgaaggaacagatgcaccatgcaagatccctttttcgacccaagatgaaagaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctctttcccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggagaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctggggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccccgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggacgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5395 - RNA, 9879 nt, synthetic construct
  misc_feature 1..9879: note = derived and/or modified CDS sequence (wt) from DENV-1__FJ639687__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacggaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagcggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgagtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgaaagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5396 - RNA, 9879 nt, synthetic construct
  misc_feature 1..9879: note = derived and/or modified CDS sequence (wt) from DENV-1__FJ639688__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgttcaagacctcagcaggtgtcaacatgtgcacccttatagcgatggatttgggagagttatgtgaggatacaatgacttataaatgccctcgaatcactgaagctgaaccagatgacgttgattgttggtgtaatgccacagacacatgggtgacctatggaacatgctcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgttcgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacacagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagtcaacattgaggcagaaccgccttttggtgagagttacattgtaataggggcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcatacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacgtttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacttaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagacgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggactgagtctagtggcatctgtggagttaccaacttccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcctccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattcttcttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggcatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaggttgcctcagaaggcttccagtactctgacagaagatggtgctttgacggagaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatctaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaggagggattgaaaagaggagaaacaaccaaacatgcagtgtcgaggggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctggaaaagacgtattctttataccacctgagaaatgtgacacccttttgtgtgatattggtgagtcctctccaaacccaactatagaggaaggaagaacgctacgcgtcctaaagatggtggaaccatggctcagaggaaaccagttttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggttacacaaatggccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaaggaaagttaggtcaaacgcagccattggagcagtgttcgttgatgaaaatcaatggaactcagcaaaagaagcagtggaagatgagcggttttgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaatgaggccagaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggtcaggtcggaacttatggcttgaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatttgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgcggatccctgataggcttaacagcaagggccacctgggccaccaacatacaagtggccatataccaagtgagaagactaattgggaatgagaattatctagattacatgacatcaatgaagagattcaagaacgagagtgatcccgaaggggcactctggtga

SEQ ID NO: 5397 - RNA, 9879 nt, synthetic construct
  misc_feature 1..9879: note = derived and/or modified CDS sequence (wt) from DENV-1__FJ639689__SS-prME
  source 1..9879: mol_type = other RNA
tctgtgaccatgctccttatgctgatgcctacagccttggcgttccatttgactatacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtcgttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtgtctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgaccgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacagttggattgagtctagtggcatctgtggagttaccaaattccttggaggagctgggggatggacttgcaatgggcattatgattttaaaattattgactgactttcaaccacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggagtcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaggcaactctgctagcagtttcaggggtgtacccattatcaataccagcgactcttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccaggaaaaaaccccaaaaatgtgcaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggattactgacttcccaggcaaaacagtttggtttgttccaagcattaaatcaggaaatgacatagccaactgcttaagaaagaatgggaaacgggtgattcaattgagtaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtagccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5398 - RNA, 9879 nt, synthetic construct
  misc_feature 1..9879: note = derived and/or modified CDS sequence (wt) from DENV-1__FJ639690__SS-prME
  source 1..9879: mol_type = other RNA
tctgtgaccatgctccttatgctgatgcctacagccttggcgttccatttgactatacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtcgttgtaggagatgttgctgggatcttggctcaaggaaagaaaatgattaggccacaacccatggaatacaaatactcgtggagaagctggggaaaggccaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccattaaggacagcaaggcagttcacgctgacatggggtactggatagaaagtgaaaagaacgagacctggaagctggcaagagcctctttcatagaagtcaaaacatgtgtctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgaccgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacagttggattgagtctagtggcatctgtggagttaccaaattccttggaggagctgggggatggacttgcaatgggcattatgattttaaaattattgactgactttcaaccacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgactcttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccaggaaaaaaccccaaaaatgtgcaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggattactgacttcccaggcaaaacagtttggtttgttccaagcattaaatcaggaaatgacatagccaactgcttaagaaagaatgggaaacgggtgattcaattgagtaggaaaacttttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtagccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaatctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtacatagagagagggagcttcacaaacagggaaaatgtgccacgtgtgtttacaacatgatggggaagagagagaagaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5399 - RNA, 9879 nt, synthetic construct
  misc_feature 1..9879: note = derived and/or modified CDS sequence (wt) from DENV-1__FJ639691__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgaaggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcatatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaactgctaaactgaggtggtttgtggagaggaatcttgtgaaaccagaagggaaagtcatagacctcggttgtggaagaggtggctggtcatactattgcgccgggttgaagaaagtcacagaagtgaagggatacacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtagacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcgaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaatgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttctcacccagcgaattagagaccccaaatttagccgagagaactctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcttgaaggggcactctggtga

SEQ ID NO: 5400 - RNA, 9879 nt, synthetic construct
  misc_feature 1..9879: note = derived and/or modified CDS sequence (wt) from DENV-1__FJ639692__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttattgcgatggatttgggagagttatgtgaggacacaatgacttacaaatgccctcgaatcactgaagccgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacttctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaaactggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtctttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcactaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgacctcgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttgcatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgacgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattacggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtgttctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggtcagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaataagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagggagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgatagatttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5401 - RNA, 9879 nt, synthetic construct
  misc_feature 1..9879: note = derived and/or modified CDS sequence (wt) from DENV-1__FJ639693__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccataaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtgatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagttaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaaggaaaaaaaatgattaggccacaacccatggaatacaagtactcgtggaaaagctggggaaaggctaaaatcataggggcagatgtgcagaataccaccttcatcatcgacggcccgaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttctgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagcggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgttgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccgtcggatttcagaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcgaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagggaaactgcatgcctaggcaagtcatatgcacaaatgtggcagctgatgtacttccacaggagagacctgagactagccgctaatgctatctgttcagccggtccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcagtggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5402 - RNA, 9879 nt, synthetic construct
  misc_feature 1..9879: note = derived and/or modified CDS sequence (wt) from DENV-1__FJ639694__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttactgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacttttgatacagagtaccaaaaaacaaaaaacaacgactgggactacgtcgtcacaacagacatctccgaaatgggagctaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatattgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatccccaggaaaattttggaacaccacgatagcggtttccatggcaaacattttcagaggaagttatctagcaggagcaggtctggccttctcattgatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctgggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccacatatccaattggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5403 - RNA, 9879 nt, synthetic construct
  misc_feature 1..9879: note = derived and/or modified CDS sequence (wt) from DENV-1__FJ639695__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggtgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagataaaccaacattagacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagcctaatgacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttctccttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcagggaaaacaagaagataccttccagccatagtccgtgaggccataaaaaggaagctgcgtacactaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggagccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggggcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgtctggctggaaaaatatggcgtcgaaaggctgaaaagaatggcaatcagcggagatgactgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5404 - RNA, 9879 nt, synthetic construct
  misc_feature 1..9879: note = derived and/or modified CDS sequence (wt) from DENV-1__FJ639696__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatatttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccactttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttacggaaatggagtagtgacaacaagtggaacctacgttagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagttgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgtgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttaactggtggagtgacgctgttcttcctatcaggaaggggcctagggaaaacatctatcggcctactctgcgtgatggcctcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaggtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcgaaagaagcagtggaagatgagcggttctgggaccttgtgcacagagagagggagcttcacaaacagggaaaatgcgctacgtgtgtttacaacatgatggggaagagagagaaaaaactaggagagttcggaaaggcaaaaggaagtcgtgcaatatggtacatgtggttaggagcacgctttctagagttcgaagctcttggtttcatgaacgaggatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttctcacccagcgaattagagaccccaaatttagccgagagagctctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcttgaaggggcactctggtga

SEQ ID NO: 5405 - RNA, 9879 nt, synthetic construct
  misc_feature 1..9879: note = derived and/or modified CDS sequence (wt) from DENV-1__HM181937__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctggaatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtaattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcataaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatagaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5406 - RNA, 9879 nt, synthetic construct
  misc_feature 1..9879: note = derived and/or modified CDS sequence (wt) from DENV-1__HM181939__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaataccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaagaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaagatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatacaaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaattcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagttctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5407 - RNA, 9879 nt, synthetic construct
  misc_feature 1..9879: note = derived and/or modified CDS sequence (wt) from DENV-1__HM181942__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaataccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaagatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttagatcctgtggtttatgatgcaaaatttgagaaacaactaggccaaataatgttgttgatactatgcacatcacaaatcctcttgatgcggaccacatgggccttgtgcgaatccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatacaaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaattcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagttctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5408 - RNA, 9879 nt, synthetic construct
  misc_feature 1..9879: note = derived and/or modified CDS sequence (wt) from DENV-1__HM488255__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagcggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcatcaaatcaggaaatgacatagccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaagaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaaaattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagagccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5409 - RNA, 9879 nt, synthetic construct
  misc_feature 1..9879: note = derived and/or modified CDS sequence (wt) from DENV-1__HM181944__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggcaatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaataccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacgaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatctagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaagaatgatgtgccgctagctgggccactgatagccggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaagatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatacaaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaattcaatcttcaagctaacataccaaaataaggtggtaagggtacagagaccagcaaaaaatggaaccgtgatggatgtcatatctagacgtgaccagagaggaagtggccaggtcggaacttatggcttaaatactttcaccaacatggaagcccagctgataagacagatggagtctgaaggaatcttttcacccagcgaattagagaccccaaatttagccgagagagttctcgactggctggaaaaacatggcgttgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 5410 - RNA, 9879 nt, synthetic construct
  misc_feature 1..9879: note = derived and/or modified CDS sequence (wt) from DENV-1__HM181946__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcatttaagctagagaaagaagtggctgagacccagcatggaaccgttctagtgcagattagatatgaaggaacagatgcaccatgcaagatccctttttcgacccaagatgaaagaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctctttcccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggagaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcatcaaatcaggaaatgacatagccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccccgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggacgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5411 - RNA, 9879 nt, synthetic construct
  misc_feature 1..9879: note = derived and/or modified CDS sequence (wt) from DENV-1__HM181948__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagttgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgtcatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcccgagagatcatggaactcaggctatgagtggatcactgacttcccaggtaaaacagtttggtttgttccaagcatcaaatcaggaaatgacatagccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaaaattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5412 - RNA, 9879 nt, synthetic construct
  misc_feature 1..9879: note = derived and/or modified CDS sequence (wt) from DENV-1__HM181949__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacaggacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagcggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggttgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgttaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcatcaaatcaggaaatgacatagccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaagaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaaaattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagagccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5413 - RNA, 9879 nt, synthetic construct
  misc_feature 1..9879: note = derived and/or modified CDS sequence (wt) from DENV-1__HM181950__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgttaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccactatggcaaaagacaaaccaacattggacattgaactcttgaagacggaagtcacaaaccctgccatcctgcgcaaactgtgcatcgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcggctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggttcgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggctttgtgcgaatccatcacactggccaccggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgagaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtagaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatagcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5414 - RNA, 9879 nt, synthetic construct
  misc_feature 1..9879: note = derived and/or modified CDS sequence (wt) from DENV-1__HM181952__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagctatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaaccgcaactataacacctcaagctcccacgacggaaatacagctgaccgactacggagctcttacattggattgttcacctagaacaggactagactttaatgaaatggtgttgctgacaatgaaagaaaaatcatggctagtccacaaacaatggtttctagacttaccactgccttggacttcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggactcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaagctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaaaagcctctttcatagaagttaaaacatgtatttggccaaaatcccacactctatggagcaatggagttctggaaagtgaaatgataattccaaagatccatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacattggctgtgttcttccttcttataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggctggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaagggaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctttttgagccggagagagaaaagagtgcagcaatagacggggaatatagactgcggggtgaagcaaggaaaacatttgtggagctcatgagaagaggagacctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaattacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccatagttggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgcgaatccatcacactggccactggacctctgaccacgctttgggagggatctccaggaaaattttggaacaccacgatagcggtttccatggcaaacatttttagaggaagttatctagcaggagcaggtctggccttctcgttaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagttatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttactaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatttgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5415 - RNA, 9879 nt, synthetic construct
  misc_feature 1..9879: note = derived and/or modified CDS sequence (wt) from DENV-1__HM181953__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggcttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgctcacctagaacaggactagactttaatgaaatggtgttgctgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggttcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccagacaacagcagtgaagagtgaacacacaggaaaagagatagttgacctcatgtgtcacgccactttcaccatgcgcctcctgtctcccgtgagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaataacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagatggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaagggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacattggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagttagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaggggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacgtctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5416 - RNA, 9879 nt, synthetic construct
  misc_feature 1..9879: note = derived and/or modified CDS sequence (wt) from DENV-1__KF921933__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaaaatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagcggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggttgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagactaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaacctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgttaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaagccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcatcaaatcaggaaatgacatagccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgggcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaaaattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagacgattgcgtggtgaaaccaattgatgataggtttgcaacagccttaacagctctgaacgatatgggaaaagtaagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagagccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5417 - RNA, 9879 nt, synthetic construct
  misc_feature 1..9879: note = derived and/or modified CDS sequence (wt) from DENV-1__HM181954__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgttaacatgtgcacccttatagcgatggatttgggagagttatgtgaggacacaatgacctacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccactatggcaaaagacaaaccaacattggacattgaactcttgaagacggaagtcacaaaccctgccatcctgcgcaaactgtgcatcgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggaccccgggagcttcaacatcacaagagacttggaacagacaagatttgctggtgacatttaagacagcccatgcaaagaagcaggaagtagtcgtactaggatcacaagaaggagcaatgcacaccgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagcgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggcctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggctttgtgcgaatccatcacactggccaccggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgagaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtagaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggtgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggattccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5418 - RNA, 9879 nt, synthetic construct
  misc_feature 1..9879: note = derived and/or modified CDS sequence (wt) from DENV-1__HM181955__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagccgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaataccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaaactggcaagagcctctttcatagaagttaaaacatgtatctggccaaaatcccacactctatggagcaatggagttctagaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatggctgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggttgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctggtggcatctgtggagttaccaaattccttggaggagctgggggatggacttgcaatgggcattatgattttaaaattattgactgactttcaatcacatcagctgtgggctaccttgctgtctttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacttacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaattccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcgaacatttccctgacagccattgcaaaccaggcagctatattgatgggacttgacaaaggatggccaatatcgaagatggacataggagttccacttcttgccttggggtgctattcccaggtgaatccactgacgctgacagcggcggtattgatgctagtggctcattacgccataattggacctggactgcaagcaaaagcaactagagaagctcaaaaaaggacagcggccggaataatgaaaaatccaaccgttgacgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatacacaaaagggggacctggacatgaggagccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagggagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgatagatttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5419 - RNA, 9879 nt, synthetic construct
  misc_feature 1..9879: note = derived and/or modified CDS sequence (wt) from DENV-1__HM181959__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaagccgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaataccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcataccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaagtcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaaactggcaagagcctctttcatagaagttaaaacatgtatctggccaaaatcccacactctatggagcaatggagttctagaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatggctgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggttgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctggtggcatctgtggagttaccaaattccttggaggagctgggggatggacttgcaatgggcattatgattttaaaattattgactgactttcaatcacatcagctgtgggctaccttgctgtctttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacttacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaattccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcgaacatttccctgacagccattgcaaaccaggcagctatattgatgggacttgacaaaggatggccaatatcgaagatggacataggagttccacttcttgccttggggtgctattcccaggtgaatccactgacgctgacagcggcggtattgatgctagtggctcattacgccataattggacctggactgcaagcaaaagcaactagagaagctcaaaaaaggacagcggccggaataatgaaaaatccaaccgttgacgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatacacaaaagggggacctggacatgaggagccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagggagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgatagatttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5420 - RNA, 9879 nt, synthetic construct
  misc_feature 1..9879: note = derived and/or modified CDS sequence (wt) from DENV-1__JF937651__SS-prME
  source 1..9879: mol_type = other RNA
tctgtgaccatgctccttatgctgatgcctacagccttggcgttccatttgactacacgagggggagagccgcacatgatactcagcaagcaggaaagaggaaaatcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgttaccactatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaaactgactctaaaagggatgtcatatgtgatgtgcacaggctcattcaagctagagaaagaagtggctgagacccagcatggaaccgtcctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttgcgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcatatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccgctaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctactggcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggctataaaaaggaagttgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtattggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaagcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggctgtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtgttctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaatctagatatcattggccagaggatagagaacataaaacatgaacacaagtcaacatggcattatgatgaggacaatccatataaaacatgggcctatcatggatcgtatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctctctagaaacaagaaaccaagaatttgcacaagagaggagttcacaggaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtagaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccaaaggggcactctggtga

SEQ ID NO: 5421 - RNA, 9879 nt, synthetic construct
  misc_feature 1..9879: note = derived and/or modified CDS sequence (wt) from DENV-1__GU131956__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccctttttttagcacatgccataggaacatccatcactcagaaagggaccattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccactttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5422 - RNA, 9879 nt, synthetic construct
  misc_feature 1..9879: note = derived and/or modified CDS sequence (wt) from DENV-1__GU131958__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaggcggactcgggatgtgtaatcaactggaagggcagagaactcaaatgtggaagtggcatttttgttaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgccacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaagtctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgaatcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttaccaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5423 - RNA, 9879 nt, synthetic construct
  misc_feature 1..9879: note = derived and/or modified CDS sequence (wt) from DENV-1__GQ868499__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcggacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggtaacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgttgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccttggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagctggcccctcaatgaaggaattatggctattggaatagttagcattctactaagttcactcctcaaaaatgatgtgccgttggctggcccactaatagctggaggcatgctaatagcatgttatgtcatatctggaagctcagccgatttatcattggagaaagtggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacattggctactggacccctgaccaccctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccctatggtcacacaaatagctatgaccgacaccacaccctttggacaacagagagtgtttaaagagaaagttgacacgcgcacaccaagagcaaaacgaggcactacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5424 - RNA, 9879 nt, synthetic construct
  misc_feature 1..9879: note = derived and/or modified CDS sequence (wt) from DENV-1__GQ868500__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaatccgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttaatggctactttcaaaatgagaccaatgttcgctgttgggctattatttcgcagactaacatctagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcctctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcagtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaatcaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcgtgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcaaacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttggtgaaaaccaatggaactcagcaaaagaagcagtggaagacgaaagggtttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagctggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactgataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5425 - RNA, 9879 nt, synthetic construct
  misc_feature 1..9879: note = derived and/or modified CDS sequence (wt) from DENV-1__GU131961__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcctgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaggctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttagaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttggactattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactccttaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaactcccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaactatctagactatatgacatcaatgaagagattcaagaatgagagtgatcccgaaggggtactctggtga

SEQ ID NO: 5426 - RNA, 9870 nt, synthetic construct
  misc_feature 1..9870: note = derived and/or modified CDS sequence (wt) from DENV-1__GU131962__SS-prME
  source 1..9870: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcacggaatacgcatcagcaggacttgcaattattgtccctctcccattggacacctatggacggaaccgattaaagatacactctggaaaagatgtattttttatgccacctgagaaaggtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5427 - RNA, 9879 nt, synthetic construct
  misc_feature 1..9879: note = derived and/or modified CDS sequence (wt) from DENV-1__GU131963__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcctgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcaagtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagaatgagagtgatcccgaaggggcactctggtga

SEQ ID NO: 5428 - RNA, 9879 nt, synthetic construct
  misc_feature 1..9879: note = derived and/or modified CDS sequence (wt) from DENV-1__KF955442__SS-prME
  source 1..9879: mol_type = other RNA
tccgtgaccatgcttctcatgctgctgcccacagccctggcgttccatttgaccacacgagggggagagccacacatgatagttagcaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcctgaagacggaggtcacgaaccctgctatcttgcgcaaactgtgtattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaagtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgatggtaccacagttgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaatcatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaattgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcagggaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcttccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 5429 - RNA, 9879 nt, synthetic construct
  misc_feature 1..9879: note = derived and/or modified CDS sequence (wt) from DENV-1__GU131965__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggttttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaactgcatatggggttctgtttagcggtgtttcttggactatgaaaataggaatagggattctgctgacatggttgggattaaattcaaggaacacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcataggagcagacatacaaaataccaccttcatcatcgacggcccagacaccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgagggtaccacagtcgttgtggatgaacattgtggaaatcgaggtccttctctcagaaccacaacagccacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtatccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagactttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtggacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaatatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggacttcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagctttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5430 - RNA, 9879 nt, synthetic construct
  misc_feature 1..9879: note = derived and/or modified CDS sequence (wt) from DENV-1__GU131966__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactatagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaggttcttcttctcacgattggattaagcttggtggcatccgtggagctaccaaattctttagaggagctaggggatggacttgcaatgggtatcatgatgttaaaattattgactgaatttcagccacaccagttgtggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggattgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccagctgagcaagtcagaattcaacacctacagaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggtgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5431 - RNA, 9879 nt, synthetic construct
  misc_feature 1..9879: note = derived and/or modified CDS sequence (wt) from DENV-1__GQ868501__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgtttagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccatcggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacattaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgtcttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaaccaaatctggggaaggaaaagttggcccctcaatgaaggaattatggcaattggaatagttagcattctactaagttcactcctcaaaaatgatgtgccgttggccggcccactgatagctggaggcatgctaatagcatgttatgtcatatccggaagctcagccgatttatcattggagaaaacggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttgtccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgttgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcctcatggcgacatatggatggaacctagtagagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagagagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaagactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5432 - RNA, 9879 nt, synthetic construct
  misc_feature 1..9879: note = derived and/or modified CDS sequence (wt) from DENV-1__HQ166035__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacggctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactatgctggcagtctcaggagtgtaccccatgtcaataccagcaactccttttgtgtggtacttttggcagaaaaagaaacagagaatcagagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagaggaaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5433 - RNA, 9879 nt, synthetic construct
  misc_feature 1..9879: note = derived and/or modified CDS sequence (wt) from DENV-1__GQ868502__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccctttttttagcacatgccataggaacatccatcactcagaaagggaccattttcattttgctgatgctggcgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgactcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagacagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccactttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggactagcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaaccatgtttctcataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggaaatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacacccttcggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagaatttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5434 - RNA, 9879 nt, synthetic construct
  misc_feature 1..9879: note = derived and/or modified CDS sequence (wt) from DENV-1__GQ868503__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgtagactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaaaatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaattggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggagagagcctccttcatagaagtcaagacatgcacctggccgaaatctcacactctatggagcaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccctttacgtttcagaggagaagacggatgttggtatggcatggaaatcagaccagtaaaggagaaggaggagaatttagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaggaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtatcttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagatattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactcctcaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgttattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtacacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5435 - RNA, 9879 nt, synthetic construct
  misc_feature 1..9879: note = derived and/or modified CDS sequence (wt) from DENV-1__GQ868504__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgctctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagggtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtaccccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5436 - RNA, 9879 nt, synthetic construct
  misc_feature 1..9879: note = derived and/or modified CDS sequence (wt) from DENV-1__GU131967__SS-prME
  source 1..9879: mol_type = other RNA
tccgtgaccatgcttctcatgctgctgcccacagccctggcgttccatttgaccacacgagggggagagccacacatgatagtcagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaacgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatggggaacctatcccactggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctctccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagggacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5437 - RNA, 9879 nt, synthetic construct
  misc_feature 1..9879: note = derived and/or modified CDS sequence (wt) from DENV-1__GU131968__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgtagactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaagtcaaatacgaaggaacagacgcgccatgcaagatccccttttcgacccaaaatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaattggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggagagagcctccttcatagaagtcaagacatgcacctggccgaaatctcacactctatggagcaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccctttacgtttcagaggagaagacggatgttggtatggcatggaaatcagaccagtaaaggagaaggaggagaatttagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatgggactatgaaaataaaagatgaagagagggatgacacactcactatactccttaaagcaactttgctggcagtctcaggagtgtacccaatgtcaataccagcaactctttttgtgtggtacttttggcagaaaaggaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagatattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactcctcaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgttattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagctaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtacacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5438 - RNA, 9879 nt, synthetic construct
  misc_feature 1..9879: note = derived and/or modified CDS sequence (wt) from DENV-1__GQ868506__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagggagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5439 - RNA, 9879 nt, synthetic construct
  misc_feature 1..9879: note = derived and/or modified CDS sequence (wt) from DENV-1__GQ868507__SS-prME
  source 1..9879: mol_type = other RNA
tccgtgaccatgcttctcatgctgctgcccacagccctggcgttccatttgaccacgcgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttaccctctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggataatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5440 - RNA, 9879 nt, synthetic construct
  misc_feature 1..9879: note = derived and/or modified CDS sequence (wt) from DENV-1__GQ868508__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcctctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5441 - RNA, 9879 nt, synthetic construct
  misc_feature 1..9879: note = derived and/or modified CDS sequence (wt) from DENV-1__GQ868509__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaagtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagatgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatcggtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagtcacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagtccttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaggatgaagagagggatgacacactcactatactccttaaagcaactttgctggcagtctcaggagtgtacccaatgtcaataccagcaactctttttttatggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactggagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5442 - RNA, 9879 nt, synthetic construct
  misc_feature 1..9879: note = derived and/or modified CDS sequence (wt) from DENV-1__GQ868510__SS-prME
  source 1..9879: mol_type = other RNA
tccgtgaccatgcttctcatgctgctgcccacagccctggcgttccatttgaccacacgagggggagagccacacatgatagttagcaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcggacaccgacgagagaaacgttccgtggcactggccccacacgtgggactaggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtggaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggatagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacgggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacattatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggtccagataccccagaatgccccgatatccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccaattatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatctttaggatgcaaaccgttaactatgtttcttataacagaaaacaaaatctggggaagaaaaagctggcccctcaatgaaggaattatggctattggaatagttagcattctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagtttttcaagacggcgtgtttcacacaatgtggcacgtcaccaggggagctgtccttatgtaccaagggaagaggctggaaccaagctgggccagtgtaaagaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatattaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctgatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgcgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccaccctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagaaggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgtcttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgacaccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagaccactggtttagcagagagaattcactcagtggagtggaaggagaaggactgcacaaacttggatacatactcagagacatatcaaagattccggggggaaatatgtatgcagatgatacagccggttgggacacaagaataacagaggatgatctccagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttgggaaaacatggcgccgaaaggctgaaaagaatggcaatcagcggagatgattgcgtggtgaaaccaattgatgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5443 - RNA, 9879 nt, synthetic construct
  misc_feature 1..9879: note = derived and/or modified CDS sequence (wt) from DENV-1__GQ868511__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggatacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggacttcaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcgcaggaaggagcaatgcacactgcgttgactggggcgacagaaatccagacgtcaggaacgacaacaatctttgcaggacatctgacatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctctataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggcatcatgatgttaaaattattgactgaatttcagccacaccagttatggaccaccttactgtctctgacattcattaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatctatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccagggatcatggaacacgggagaagaagtgcaggtgatagctgttgaaccaggaaaaaacccaaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagctatagtccgtgaggccataaaaaagaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaggcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaagatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggccactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacgcctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaagtttttgggatctcgtgcacaaagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatgggggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5444 - RNA, 9879 nt, synthetic construct
  misc_feature 1..9879: note = derived and/or modified CDS sequence (wt) from DENV-1__GQ868512__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgtcgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5445 - RNA, 9879 nt, synthetic construct
  misc_feature 1..9879: note = derived and/or modified CDS sequence (wt) from DENV-1__GU131970__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcatcgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtggtcgtactgggatcacaggaaggagcaatgcacactgcgctgactggggcgacagaaatccagacgtcaggaacgacaacaatctttgcaggacatctgaaatgcagactaaaaatggataaactgactttaaaagggacatcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacattgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaagggaaaaaaacgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttacctcccttacgtttcagaggagaagacggatgttggtatggcatggaaatcagaccagtaaaggagaaggaggagaatctagttaggtcaatggtctctgcaggttcaggagaagtggacagtttttcattaggaatactatgcgtatcaataatgattgaagaagtgatgagatccagatggagtagaaagatgctgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaattccatccacaccagttatggaccaccttactgtctctgacattcatcaaaacaactctatcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaagaaaaagctggcccctcaatgaaggaattatggctattggaatagttagcattctactaagttcactcctcaaaaatgatgtgccgttggccggcccactaatagctggaggcatgctaatagcatgttatgtcatatctggaagctcagccgatttatcattggagaaagcggctgaggtgtcttgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaggatttgatctcatatggaggaggttggaggtttcaaggatcatggaatacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagtcgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcacagattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagctggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggagatagggaaacttccacaacatttgacgctaagagcccagaatgctctagataacttggtcatgttgcacaattccgaacaaggaggaaaagcctatagacatgccatggaggaactaccagacaccatagaaacattgatgcttctagctttgatagctgtgttgactggtggagtgacgctgtttttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttatttatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggccactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggaggcatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaagacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgacaccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacacgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaagtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgaaagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagactatatgacatcaatgaagagattcaagaatgagagtgatcccgaaggggcactctggtga

SEQ ID NO: 5446 - RNA, 9879 nt, synthetic construct
  misc_feature 1..9879: note = derived and/or modified CDS sequence (wt) from DENV-1__KF955427__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaagcgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttggcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgtggactggggccacagaaatccagacgtcaggaacgacaacaatctttgcaggacatttgaaatggagactaaaaatggataaactgactttaaaagggacgtcatatgtgatgtgcaccggctcatttaagctagagaaggaagtggctgagactcagcatggaactggtctagtccaggtcaaatacgaaggaacagacgcgccatgcaagatccccttttccgcccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaactgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccccaacccatggaacacaaatactcatggaaaagctggggaaaagctaaaatcataggagcagacatacaaaataccaccttcatcatcgacggcccagataccccagaatgccccgacaaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgagggtaccacagttgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagccaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttgcccgacccactaatagcaggaggcatcctaatagcatgttatgtcatatccggaagctcagccgatttatcattggagaaagcggctgagatgtcctgggaacaagaggcagaacattccggtacctcacacaacatactagtagaggtccaagatgatggtcctatgaaaataaaagatgaagagagggatgacacactcactatactccttaaagcaactttgctggcagtctcaggagtgtatccaatgtcaataccaggaactctttttgtgtggtacttttggcagaaaaagaaacagagatcaggagtgttatgggacacacccagtcctccgaaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttactatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtatcaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtatctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcttcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5447 - RNA, 9879 nt, synthetic construct
  misc_feature 1..9879: note = derived and/or modified CDS sequence (wt) from DENV-1__GQ868513__SS-prME
  source 1..9879: mol_type = other RNA
tccgtgaccatgcttctcatgctgctgcccacagccctggcgttccatttgaccacgcgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcccactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattctggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5448 - RNA, 9879 nt, synthetic construct
  misc_feature 1..9879: note = derived and/or modified CDS sequence (wt) from DENV-1__GU131973__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctctaaaactaagctggttcaagaaaggaagcagcatagggaaaatgttcgaagcaaccgcccgaggagcacgaaggatggctattctgggagacaccgcatgggactttggctccataggaggagtcttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggccattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaaatgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggagatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5449 - RNA, 9879 nt, synthetic construct
  misc_feature 1..9879: note = derived and/or modified CDS sequence (wt) from DENV-1__GQ868517__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttttagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatcccctttttgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactatagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaggttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactcctcaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagccgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttactatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacaaagcaatgcagttatccaagacgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaacaccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgttttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaattactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggtgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5450 - RNA, 9879 nt, synthetic construct
  misc_feature 1..9879: note = derived and/or modified CDS sequence (wt) from DENV-1__GU131976__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtagtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcactaatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactacggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaaaagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcaccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggctctctggtga

SEQ ID NO: 5451 - RNA, 9879 nt, synthetic construct
  misc_feature 1..9879: note = derived and/or modified CDS sequence (wt) from DENV-1__GQ868518__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcattcaagctagagaaggaagtggctgagactcagcatggaactgttctagtgcaggtcaaatacgaaggaacagacgcgccatgcaagatccccttttcgacccaagatgagaaaggggtgactcagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaactgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgagggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattacgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccattaatagcaggaggcatgctaatagcatgttatgtcatatccggaagctcagccgatttatcattggagaaagcggctgaggtgtcctgggaacaagaggcagaacattctggtccctcacacaacatactagtagaggtccaagatgatggaactatgaaaataaaagatgaagagagggatgacacactcactatactccttaaagcaactttgctggcagtctcaggagtgtatccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccgaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggaccacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgtcaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcctcaagcgcactgttgtggatggccagtgtggagccccattggatagcggcctccattatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaagtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggataatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgctacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5452 - RNA, 9879 nt, synthetic construct
  misc_feature 1..9879: note = derived and/or modified CDS sequence (wt) from DENV-1__GQ868519__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagccaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatcccctttttgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagctggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagctcgctttctggaattcgaagcccttggtttcatgaatgaagatcactggtttagcagagagaattcactcagtggagtggaaggagaaggactgcacaaacttggatacatactcagagatatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5453 - RNA, 9879 nt, synthetic construct
  misc_feature 1..9879: note = derived and/or modified CDS sequence (wt) from DENV-1__KF955443__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccctggacttcgggggcttcaacatcccaagagacctggaacagacaagatttgctggtcacattcaagacagctcatgcaaagaaacaggaagtagtcgtactgggatcacaggaaggagcaatgcacactgcgctgactggggcgacagaaatccagatgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatcggtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagtcacgcgtcttgagaacatcatgtggaagcaaatatcaaatgaattgaaccacattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagtccttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttttatggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactggagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaccctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5454 - RNA, 9879 nt, synthetic construct
  misc_feature 1..9879: note = derived and/or modified CDS sequence (wt) from DENV-1__GQ868520__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctggagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaggcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatttgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctaaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagatggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcacccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaatgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaagatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgcggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5455 - RNA, 9879 nt, synthetic construct
  misc_feature 1..9879: note = derived and/or modified CDS sequence (wt) from DENV-1__GQ868522__SS-prME
  source 1..9879: mol_type = other RNA
tccgtgaccatgcttctcatgctgctgcccacagccctggcgttccatttgaccacacgaggaggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcaacatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtatcaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagcgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5456 - RNA, 9879 nt, synthetic construct
  misc_feature 1..9879: note = derived and/or modified CDS sequence (wt) from DENV-1__HQ166036__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgactcagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaactgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgagggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattacgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattctggtacctcacacaacatactagtagaggtccaagatgatggaactatgaaaataaaagatgaagagagggatgacacactcactatactccttaaagcaactttgctggcagtctcaggagtgtatccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccgaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgtcaagagcccagaatgctctggataacttggtcatgttgcacaattctgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcctcaagcgcactgttgtggatggccagtgtggagccccattggatagcggcctccattatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaagtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgctacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaacttataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5457 - RNA, 9879 nt, synthetic construct
  misc_feature 1..9879: note = derived and/or modified CDS sequence (wt) from DENV-1__GU131981__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcatggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttccattatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtgcagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggatagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagatatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5458 - RNA, 9879 nt, synthetic construct
  misc_feature 1..9879: note = derived and/or modified CDS sequence (wt) from DENV-1__GQ868529__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagacagttcaatatgaaaacttaaaatattcggtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaatttacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaatagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggttggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaagaaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatgttagaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgacgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacttggacatgaggaccccatcccaatggcgacctatggctggaacctagtaaagttactggctggaaaagatgtattttttatgccacctgagaaatgtgacacccttctgtgtgatattggggagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5459 - RNA, 9879 nt, synthetic construct
  misc_feature 1..9879: note = derived and/or modified CDS sequence (wt) from DENV-1__GQ868531__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacttaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtaacggcctccagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatacttagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgtctaggcaagtcatatgcacaaatgtggcagctgatgtacttccacaggagagacctgagactggcggctaacgctatcagttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5460 - RNA, 9879 nt, synthetic construct
  misc_feature 1..9879: note = derived and/or modified CDS sequence (wt) from DENV-1__GU131983__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactatcaggagcaacgtgggtggacgtggtattggagcatggaagctgcgtcaccaccatggcaaaaaataaaccaaccttggacattgaactcttgaagacggaggtcacgaaccctgccatcttgcgcaaactgtgcattgaagctaaaatatcaaacaccaccaccgactcaagatgtccaacacaaggagaggccacattggtggaagaacaagacgcgaactttgtgtgtcgccgaacgtttgtggacagaggctggggcaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacaggcaagatttgctggtcacattcaagacagctcatgcaaagaaacaggaagtagtcgtactgggatcgcaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcgaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgaaaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattagattttgacttgtgtgaaggtaccacagtcgttgtggatgaacattgtggaaatcgaggtccttctctcagaaccacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgattggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatctatcattggagaaagcggctgaggtgtcctgggaacaagaggcagaacattccggtacctcacacaacatactagtagaggtccaagacgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtgggacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagggttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaggatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcattccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgcccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttaatgttagtggcccattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattgatgaaatctttaggaggaggcaggagaggtacgggagctcaaggggaaacactgggagagaaatggaaaagacagttaaaccaactgagcaagtcagaattcaacacctataaaaggagtggaattatggaggtggacagatccgaagctaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcgaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaagaaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacacatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5461 - RNA, 9879 nt, synthetic construct
  misc_feature 1..9879: note = derived and/or modified CDS sequence (wt) from DENV-1__GQ868532__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtttagaaacgagaaccgaaacatggatgtcctctgaaggcgcctggaagcaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccctttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctgggcaagttggaattggattttgacttgtgtgaaggtaccacagtcgttgtggatgaacattgtggaaatcgagggccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaaactcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccatacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctccaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctaactttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgagaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaaatgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatggtatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5462 - RNA, 9879 nt, synthetic construct
  misc_feature 1..9879: note = derived and/or modified CDS sequence (wt) from DENV-1__GQ868533__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttggcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatacgtgatgtgcacaggctcatttaagctagagaaggaagtggctgagactcagcatggaactgttctagtgcaggtcaaatacgaaggaacagacgcgccatgcaagatccccttttcgacccaagatgagaagggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgtttacatctgtgggaaaattggtacaccaggtttttggaactgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcatagaagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgagggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagcagatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtatccaatgtcaataccagcaactctttttttgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgtcgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaaaggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgtcaagagcccagaatgccctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggaccctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagcaaagctacactctggaaaagatgtattttttatgccacctgagaaatgtgacactcttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacaaaacatgggcctatcatggatcatatgaggtcaagtcatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatttgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaggaagttccatacctagggaaaagagaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5463 - RNA, 9879 nt, synthetic construct
  misc_feature 1..9879: note = derived and/or modified CDS sequence (wt) from DENV-1__GQ868534__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacacaggggaccagcaccaggtgggaaacgagactacagaacatggaacaattgcgaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaggatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcgtttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactacgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagaatgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggattgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttattccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacggccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcgaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagctcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcgtatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacttagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5464 - RNA, 9879 nt, synthetic construct
  misc_feature 1..9879: note = derived and/or modified CDS sequence (wt) from DENV-1__GQ868535__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggtgaacaccgacgagacaaacgttctgtggcactggccccacacgtgggacttggtctagaaacaagaaccgaaacatggatgtcatctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggttgcgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaatagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgaaacccagcatggaactgttctagtgcaggtcaaatacgaaggaacagacgcgccatgcaagatccccttttcaacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacactgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaaggtaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacattggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacatgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgacattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaatctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaagttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggctacatactcagagatatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgatgacaggttcgctacagccttaacagccctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5465 - RNA, 9879 nt, synthetic construct
  misc_feature 1..9879: note = derived and/or modified CDS sequence (wt) from DENV-1__KJ189306__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggatattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgttcacactggggaccagcaccaggtgggaaacgagactacagaacatggaacaattgcgaccataacacctcaagcccctacgtcggaaatacagctgaccgactacggagccctcacattggattgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaaggaacgtcatatgtgatgtgtacaggcccatttaagctagagaaggaagtggctgagactcagcatggaactgttctagtgcaggtcaaatacgaaggaacagacgcgccatgcaagatcccctttttgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggtaacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctcagcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggttattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacttcccaaaaaacaacatggcttccggtgctgttaggatcttttggatgcaaaccgttaactatgtttcttataacagaaaacaaaatctggggaaggaaaagttggccccttaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagagagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggagattccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttgacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaactacaacatgatcatcatggacgaagcacattttaccgatccagccagcatagcggccagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggacaacttggtcatgttgcacaattccgaacaaggaggaaaagcctatagacatgccatggaggaactaccagacaccatagaaacattgatgcttctagctttgatagctgtgttgacaggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcctatgatgagacacacaattgaaaatacaacggcaaacatttccctgacagccattgcaaatcaggcagctatattgatgggacttgacaagggatggccaatatcgaagatggacataggagttccacttctcgccttagggtgctactcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacaattaaaccaactgagcaagtcagaattccacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccgatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgtgttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagacatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcataagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggaattcgaagccctcggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgctgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagctgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5466 - RNA, 9879 nt, synthetic construct
  misc_feature 1..9879: note = derived and/or modified CDS sequence (wt) from DENV-1__KJ189307__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggatttacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaacaaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggctgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccctgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactttatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacgacagtcacaggaaagataatccatgaatggtgttgcagatcctgcacgttacccccattacgtttcagaggagaagacggatgttggtatggcatggaaatcagaccagtaaaggagaaggaggagaatctagttaggtcaatggtctctgcagggtcaggagaagtggacagtttttcattaggaatactatgtgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggttattatttcgcagactaacatccagggaggttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcgtggaaaacaacggctatggcactgtcaattgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgagggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacataccagtagaggtccaagatgatggaactatgaaaataaaagatgaagagagggatgacacactcactatactccttaaagcaactttactggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggaaccttcaagactcctgaaggtgaagttggagccatagctctagattttaaacccggcacatctggatctcccatcgtgaacagagagggaaaaatagtaggtctttatggaaatggagtggtgacaacaagtgggacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcctatccccagtgagagttcccaattacaacatgatcatcatggatgaagcacattttaccgatccagccagcatagcggccagagggtacatctcaacccgagtgggcatgggtgaagcagctgcgatcttcatgacagccactcccccaggatcggtggaggcctttccacagagcaatgcagtcatccaagatgaggaaagagacattcctgagagatcatggaactcaggctacgattggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcactggacagaagcaaaaatgctccttgacaatataaacacaccagaagggatcatcccagccctctttgagccagagagagaaaagaatgcagcaatagacggggagtacagactgcggggagaagcaagaaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacacttgacgttaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcgctgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtggacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccaccctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaggggtacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaatatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatttgttcagctgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5467 - RNA, 9879 nt, synthetic construct
  misc_feature 1..9879: note = derived and/or modified CDS sequence (wt) from DENV-1__KJ189318__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgtttagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccatcggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacattaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgtcttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggcaattggaatagttagcattctactaagttcactcctcaaaaatgatgtgccgttggccggcccactgatagctggaggcatgctaatagcatgttatgtcatatccggaagctcagccgatttatcattggagaaaacggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttgtccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgttgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagagagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaagactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5468 - RNA, 9879 nt, synthetic construct
  misc_feature 1..9879: note = derived and/or modified CDS sequence (wt) from DENV-1__KJ189319__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatctcttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtacttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgccacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagctaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacatcgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5469 - RNA, 9879 nt, synthetic construct
  misc_feature 1..9879: note = derived and/or modified CDS sequence (wt) from DENV-1__KJ189320__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaaatgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactatagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaggttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactctgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacacttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggctactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattacggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggtgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacgacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5470 - RNA, 9879 nt, synthetic construct
  misc_feature 1..9879: note = derived and/or modified CDS sequence (wt) from DENV-1__KJ189323__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcgcaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggcccatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggttattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaaggcggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggacgaagcacattttaccgatccagccagcatagcggccagagggtacatctcaacccgagtgggcatgggtgaagcagctgcgatctttatgacagccactcccccaggatcggtggaggcctttccacagagcaatgcagttatccaagatgaagaaagagacattcctgagagatcatggaactcaggctacgactggatcactgattttccaggtaaaacagtctggtttgtcccaagtattaaatcaggaaatgacattgctaactgtttaagaaagaacggaaaacgggtaattcaattgagcagaaaaacctttgacactgagtaccagaaaacaaaaaataatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctactcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgagatggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctagagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaggccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctaatgtacttccacaggagagacctgagactggcggctaacgctatctgttcagctgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5471 - RNA, 9879 nt, synthetic construct
  misc_feature 1..9879: note = derived and/or modified CDS sequence (wt) from DENV-1__KJ189324__SS-prME
  source 1..9879: mol_type = other RNA
tccgtgaccatgcttctcatgctgctgcccacagccctggcgttccatttgaccacaagagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtagagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgagggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggacttcaatgagatggtgctattgacaatgaaagaaaaatcatggcttgtccacaaacaatggtttctagacttaccattgccttggacttcgggggcttcaacatcccaagagacctggaacaggcaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgagatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctgttattccgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatctatcattggagaaagcggctgaggtgtcctgggaacaagaggcagaacattccggtacctcacacaacatactagtagaggtccaagatgatggaactatgaaaataaaagatgaagagagggatgacacactcaccatactccttaaagcaactttgctggcagtctcaggagtgtacccaatgtcaataccagcaactctttttgtgtggtacttttggcagaaaaagaaacagagatcaggagtgttatgggacacacccagtcctcctgaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttgacaataatggacctgcatccaggatcaggaaaaacaagaagatatcttccagccatagtccgtgaggccataaaaaggaaactgcgtacgttaatcttggctcccacaagggttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcattccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacaggcagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggcccattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattgatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcgaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggccaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaagaaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5472 - RNA, 9879 nt, synthetic construct
  misc_feature 1..9879: note = derived and/or modified CDS sequence (wt) from DENV-1__KJ189325__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccctttttttagcacatgccataggaacatccatcactcagaaagggaccattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacactaccaccgattcaagatgtccaacacaaggagaggccacattggtggaagaacaagacgcgaactttgtgtgccgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccactttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacattggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggatcaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtattatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaatgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagatccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacggaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttgcccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5473 - RNA, 9879 nt, synthetic construct
  misc_feature 1..9879: note = derived and/or modified CDS sequence (wt) from DENV-1__KJ189326__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacggacacatgggtgacctatgggacgtgttctcaaaccggcgaacaccgacgagacaaacgttccgtggcactggccccacacgtgggacttggtctagaaacgagaaccgaaacatggatgtcctctgaaggcgcctggaaacaaatacaaagagtggagacttgggctttgagacacccaggattcacggtgatagccctttttttagcacatgccataggaacatccatcactcagaaagggaccattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacactaccaccgattcaagatgtccaacacaaggagaggccacattggtggaagaacaagacgcgaactttgtgtgccgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccggtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccactttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacattggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgctaaaattattgactgaatttcagccacaccagttatggaccaccttactgtctctgacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggattatggaacacgggagaagaagtgcaggtgatagctgttgaaccaggaaaaaaccccaaaaatgtacagacaacgccgggtaccttcaagactcctgaaggtgaagttggagccatagctctagatttcaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagatccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcccttaaacaatgatgaggatcacgctcattggacggaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgctaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttgcccagcgaattggaaacccccaatctagctgagagagttcttgactggttggaaaaacatggcgccgaaaggctgaaaagaatggcaattagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccacaaacatacaagtggccataaaccaagtgagaaggctcatcgggaatgagaattatctagattatatgacatcaatgaagagattcaagaatgagagtgatcccgaaggggcactctggtga

SEQ ID NO: 5474 - RNA, 9879 nt, synthetic construct
  misc_feature 1..9879: note = derived and/or modified CDS sequence (wt) from DENV-1__KJ189327__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcatcgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtggtcgtactgggatcacaggaaggagcaatgcacactgcgctgactggggcgacagaaatccagacgtcaggaacgacaacaatctttgcaggacatctgaaatgcagactaaaaatggataaactgactttaaaagggacatcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacattgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggctcaagggaaaaagatgattaggccacaacccatggaacacaaatactcatggaaaagctggggaaaagctaaaatcataggagcagacacacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatcccagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttacctcccttacgtttcagaggagaagacggatgttggtatggcatggaaattagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctactatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttctaataacagaaaacaaaatctggggaaggaaaagttggcccctcaatgaaggaattatggctattggaatagttagcattctactaagttcactcctcaaaaatgatgtgccgttggccggcccactgatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaaccatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagctggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccttgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5475 - RNA, 9879 nt, synthetic construct
  misc_feature 1..9879: note = derived and/or modified CDS sequence (wt) from DENV-1__KJ189328__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcatcgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtggtcgtactgggatcacaggaaggagcaatgcacactgcgctgactggggcgacagaaatccagacgtcaggaacgacaacaatctttgcaggacatctgaaatgcagactaaaaatggataaactgactttaaaagggacatcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacattgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttacctcccttacgtttcagaggagaagacggatgttggtatggcatggaaatcagaccagtaaaggagaaggaggagaatctagttaggtcaatggtctctgcaggttcaggagaagtggacagtttttcattaggaatactatgcgtatcaataatgattgaagaagtgatgagatccagatggagtagaaagatgctgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaattccatccacaccagttatggaccaccttactgtctctgacattcatcaaaacaactctatcattggactatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaagaaaaagctggcccctcaatgaaggaattatggctattggaatagttagcattctactaagttcactcctcaaaaatgatgtgccgttggccggcccactaatagctggaggcatgctaatagcatgttatgtcatatctggaagctcagccgatttatcattggagaaagcggctgaggtgtcttgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaggatttgatctcatatggaggaggttggaggtttcaaggatcatggaatacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagtcgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcacagattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagctggaccgatgccagtgactgtggccagtgctgcccagaggagaggaagaattggaaggaaccaaaacaaggaaggtgaccagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccaggacatactctgatccattggccctgcgcgagtttaaagagtttgcagcaggaagaagaagtgtctcaggtgacctaatattggagatagggaaacttccacaacatttgacgctaagagcccagaatgctctagataacttggtcatgttgcacaattccgaacaaggaggaaaagcctatagacatgccattgaggaactaccagacaccatagaaacattgatgcttctagctttgatagctgtgttgactggtggagtgacgctgtttttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttatttatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggccactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggaggcatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaagacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgacaccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacacgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaagtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgaaagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagactatatgacatcaatgaagagattcaagaatgagagtgatcccgaaggggcactctggtga

SEQ ID NO: 5476 - RNA, 9879 nt, synthetic construct
  misc_feature 1..9879: note = derived and/or modified CDS sequence (wt) from DENV-1__KJ189329__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacgcatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatacgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaactgcatatggggttctgttcagtggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagatcagggtatttcacacaaacagcagggccatggcacctaggcaagttggaattggattttgacttgtgtgagggtaccacagtcgttgtggatgaacattgtggaaatcgaggtccttctctcagaaccacaacagtcacaggaaagataatccatgaatggtgttgcagatcctgcacgttacctcccttacgtttcagaggagaagacggatgttggtatggcatggaaatcagaccagtaaaggagaaggaggagaatctagttaggtcaatggtctctgcagggtcaggagaagtggacagtttttcattaggaatactgtgcgcatcaataatgattgaagaagtgatgagatccagatggagtagaaagatgctgatgactggaacgctggctgttttcctccttcttgtaatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaattgtatctctctttcctttatgcctgtctacgacctcccaaaaaaccacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtatccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagacgatatcttccagccatagtccgtgaggccataaaaaggaaactgcgcacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgcctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtatcaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaacttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgtcaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacagaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaatgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgataggttcgctacagccttaacagccctgaatgacatgggaaaagtaagaaaagacataccgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5477 - RNA, 9879 nt, synthetic construct
  misc_feature 1..9879: note = derived and/or modified CDS sequence (wt) from DENV-1__KJ189331__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgttggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccataaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgtttagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccatcggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacattaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgattggaacactggctgtcttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggcaattggaatagtaagcattctactaagttcactcctcaaaaatgatgtgccgttggccggcccactgatagctggaggcatgctaatagcatgttatgtcatatccggaagctcagccgatttatcattggagaaaacggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttgtccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggccatgttgcataattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgttgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaatctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagagagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaagacccatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5478 - RNA, 9879 nt, synthetic construct
  misc_feature 1..9879: note = derived and/or modified CDS sequence (wt) from DENV-1__KJ189332__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagctctttttttagcacatgccataggaacatccatcactcagaaagggaccattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattaacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgtttagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggctcaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccatcggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacattaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgtcttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggcaattggaatagtaagcattctactaagttcactcctcaaaaatgatgtgccgttggccggcccactgatagctggaggcatgctaatagcatgttatgtcatatccggaagctcagccgatttatcattggagaaaacggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttgatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttgtccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttgagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggccatgttgcataattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgttgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaatctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtaacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagagagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaagacccatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5479 - RNA, 9879 nt, synthetic construct
  misc_feature 1..9879: note = derived and/or modified CDS sequence (wt) from DENV-1__KJ189334__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaaggtctctgcaggtgtcaatatgtgcactctcattgcgatggacttgggagagttgtgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacacaggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaggatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcgtttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactacgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctactacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagaatgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttattccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacggccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcgtatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacttagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5480 - RNA, 9879 nt, synthetic construct
  misc_feature 1..9879: note = derived and/or modified CDS sequence (wt) from DENV-1__KJ189335__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttgtgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacacaggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaggatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcgtttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaaggaaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactacgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctactacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagaatgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttattccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaataaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacggccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcgtatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacttagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5481 - RNA, 9879 nt, synthetic construct
  misc_feature 1..9879: note = derived and/or modified CDS sequence (wt) from DENV-1__KJ189336__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcacccagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccactgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcattgttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaacaccaccttcatcattgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatacggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaagttgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgagaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtgttttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5482 - RNA, 9879 nt, synthetic construct
  misc_feature 1..9879: note = derived and/or modified CDS sequence (wt) from DENV-1__KJ189337__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgtagattgctggtgcaatgccacagacacatgggtgacctatgggacgtgttctcaaaccggcgaacaccgacgagacaaacgttctgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattaacaatgaaagaaaaatcatggcttgtccacaaacaatggtttctagacttaccactgccttggacttcgggggcttcaacatcccaagagatctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaattggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaagggaaaaaaatgattagaccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccctttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactgatagctggaggcatgctgatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaggaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagatattcccgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttagtcatgttgcacaattccgaacaaggaggaaaagcctatagacatgccatggaggaactaccagacaccatagaaacattgatgcttctagctttgatagctgtgttgactggtggagtgacgctgttcttcttatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactcctcaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgttattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaacctagatatcattggccagaggatagagaatgtaaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtacacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5483 - RNA, 9879 nt, synthetic construct
  misc_feature 1..9879: note = derived and/or modified CDS sequence (wt) from DENV-1__KJ189340__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagttcaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaacaccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatacggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaggtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaagttgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgctttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgagaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtgttttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaaaagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5484 - RNA, 9879 nt, synthetic construct
  misc_feature 1..9879: note = derived and/or modified CDS sequence (wt) from DENV-1__KJ189341__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcatcgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcggacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacacgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggacttcaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgaccttaaaagggacgtcatatgtgatgtgcacaggcccatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgtagttggcatagttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacacacaaaataccaccttcatcatcgacggcccagataccccagaatgccccgataaccaaagagcatggaacatctgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgtcaactatgtttcttataacagaaaacaaaatctggggaagaaaaagctggcccctcaatgaaggaattatggctattggaatagttagcattctactaagttcactcctcaaaaatgatgtgccgttggctggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattttagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtatccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctctgatagctgtgttgactggtggagtgacgctgttcttcctatcaggaaaaggtctagggaaaacatccatcggcctgctctgtgtgacggcctcaagcgcactgctgtggatggccagtgtggagctccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccaccctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcttgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgacaccacaccctttggacaacagagagtgtttaaagagaaggttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttgggaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggctgggacacaagaataacagaggatgatcttcagaatgaggctaaaatcactgacattatggagcctgaacatgctctattggctacgtcaatctttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggaaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5485 - RNA, 9879 nt, synthetic construct
  misc_feature 1..9879: note = derived and/or modified CDS sequence (wt) from DENV-1__KJ189343__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaacatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgacagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagtttaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaattgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagctaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtagtcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccatcggctaatgtcagctgccatcaaagacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactacagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacattaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgattggaacactggctgtcttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggcaattggaatagtaagcattctactaagttcactcctcaaaaatgatgtgccgttggccggcccactgatagctggaggcatgctaatagcatgttatgtcatatccggaagctcagccgatttatcattggagaaaacggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggggctgtccttatgtaccaagggaagaggctggaaccaagctgggccagtgtcaaaaaagatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttgtccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtatcaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcgaaaatgctccttgataatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggccatgttgcataattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgttgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaaaggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagatttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaatctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatttgaaagagacgtggacttaggcgctggaacaaggcatgtggcagtggaaccagaggtagccaatctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagagagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggagccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaagacccatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5486 - RNA, 9879 nt, synthetic construct
  misc_feature 1..9879: note = derived and/or modified CDS sequence (wt) from DENV-1__KJ189344__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaacatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgacagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgctaagtttaagtgtgtgacaaaactagaaggaaagatagttcaatatgaaaacctaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccattgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaattgactttaaaagggacgtcatatgtgatgtgcacaggctcatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagctaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtagtcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaacactaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttaccccccctacgcttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggcatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgacgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgatcatcatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaatcaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggataacttggtcatgttgcacaattccgaacaaggaggaaaagcctatagacacgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagctacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctggcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaactaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtagtagaagctctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatgggggttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatggggaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccataggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaatcaagtgagaaggctcatcgggaatgagaattatctagattacatgacatcaatgaagagattcaagaatgagagtgatcccgaaggggcactctggtga

SEQ ID NO: 5487 - RNA, 9879 nt, synthetic construct
  misc_feature 1..9879: note = derived and/or modified CDS sequence (wt) from DENV-1__KJ189346__SS-prME
  source 1..9879: mol_type = other RNA
tccgtcaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttggcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggggaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctccaacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagatgtcaggaacgacaacaatctttgcaggacatctgaaatgcagactaaaaatggataaactgactttaaaagggacgtcatacgtgatgtgcacaggctcatttaagctagagaaggaagtggctgagactcagcatggaactgttctggtgcaggtcaaatacgaaggaacagacgcgccatgcaagatccccttttcgacccaagatgagaagggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgtttacatctgtgggaaaattggtacaccaggtttttggaactgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagctaaaatcataggagcagacatacaaaataccaccttcatcatcgacggcccagataccccagaatgccccgataaccagagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttatggaaagtgaaatgataatcccaaagatatatggaggaccaatatctcagcacaactatagaccagggtatttcacacaaacagcagggccatggcacctaggcaagttggaattggattttgacttgtgtgagggtaccacagtcgttgtggatgaacattgtggaaatcgaggtccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattgggaatactatgcgcatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagcaggaggcatgctaatagcatgttatgtcatatccggaagctcagcagatttatcattggagaaagcggctgaggtgtcctgggaacaagaggcagaacattccggtacctcacacaacatactagtagaggtccaagatgatggaactatgaaaataaaagatgaagagagggatgatacactcactatactccttaaagcaactttgctggcagtctcaggagtgtatccaatgtcaataccagcaactctttttttgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccagaggagctgtccttatgtaccaagggaagaggctggaaccaagctgggccagtgtcaaaaaggatttgatctcatatggaggaggttggaggttccaaggatcatggaacacgggagaagaagtgcaggtgatagctgtcgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaaaggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacactttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgtcaagagcccagaatgccctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctactctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggaccctgtggtttatgatgcaaaatttgaaaaacagctaggccaaataatgttactgatactttgtacatcacagatcctcttgatgcggaccacgtgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagcaaagctacactctggaaaagatgtattttttatgccacctgagaaatgtgacactcttctgtgtgatattggtgagtcctctccgaatccaactatagaagaaggaagaacgttacgtgttctaaaaatggtggaaccatggctaagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaacggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgacgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggtacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacatactgcagtgggaaccttcaaaaggatggaatgattggcagcaagtgcctttctgttcgcaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatttgttcagccgtcccagttgattgggtcccaaccagccgcacaacctggtcaatccatgcccaccaccaatggatgacaacagaagacatgttatcagtatggaatagggtttggatagaggaaaacccatggatggaggacaaaactcatgtatccagttgggaggaagttccatacctagggaaaagagaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5488 - RNA, 9879 nt, synthetic construct
  misc_feature 1..9879: note = derived and/or modified CDS sequence (wt) from DENV-1__KJ189347__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcgcaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggcccatttaagctagagaaggaagtggctgagactcagcatggaactgttctagtgcaggtcaaatacgaaggaacagacgcgccatgcaagatcccctttttgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggaaccacagtcgttgtggatgaacattgtggaaatcgaggcccttctctcagaaccacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagctaacgcttcagacaggatggggatgggaacaacgtacctagccttgatggctactttcaaaatgagaccaatgttcgctgttgggttattatttcgcagactaacatccagagaagttcttcttctcacgattggattaagcttgatggcatctgtggagctaccaaattctttggaggagctaggggatggacttgcaatgggtatcatgatgttaaaattattgactgaatttcagccacaccagttatggaccaccttactgtctctgacattcatcaaaacaactctctcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccattggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacctggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggacgaagcacattttaccgatccagccagcatagcggccagagggtacatctcaacccgagtgggcatgggtgaagcagctgcgatctttatgacagccactcccccaggatcggtggaggcctttccacagagcaatgcagttattcaagatgaagaaagagacattcctgagagatcatggaactcaggctacgactggatcactgattttccaggtaaaacagtctggtttgtcccaagtattaaatcaggaaatgacattgctaactgtttaagaaagaacggaaaacgggtaattcaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgttattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctactcccaggtgaacccattgacactgacagcggcggtgttgatgttagtggctcattatgccataatcggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgagatggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaggccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaagatgtgccacgtgtgtctacaacatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctaatgtacttccacaggagagacctgagactggcggctaacgctatctgttcagctgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcggaaatgagaattatctagattatatgacatcaatgaagagattcaagaatgagagtgatcccgaaggggcactctggtga

SEQ ID NO: 5489 - RNA, 9879 nt, synthetic construct
  misc_feature 1..9879: note = derived and/or modified CDS sequence (wt) from DENV-1__KJ189348__SS-prME
  source 1..9879: mol_type = other RNA
tccgtgaccatgctcctcatgctgctgcccacagccctggcattccatttgaccacacgggggggagagccacacatgatagttagtaagcatgaaagaggaaagtcactcttgtttaagacttctgcaggtgtcaacatgtgcactctcattgcgatggacttgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagacaaacgttccgtggcactggccccgcacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgctaatgctggtgacaccatcaatggccatgcgatgcgtgggaataggcaacagagatttcgttgaaggactgtcaggagcaacgtgggtggacgtagtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccactaccgattcaagatgtccaacacaaggagaggctacactggtggaagaacaagacgcgaactttgtgtgtcgccgaacgtttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcatcaggtgggaaacgagactacagaacatggaacaattgcaaccataacacctcaagctcctacgtcggaaatacagctgactgactacggagccctcacattggactgctcacctagaacagggctggacttcaatgagatggtgctattgacaatgaaagaaaaatcatggcttgtccacaaacaatggtttctagacttaccactgccttggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacttgaaatgcagattaaaaatggataaactgactttaaaggggacgtcatatgtgatgtgcacaggctcatttaagttagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcataggaaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcattttcaatgacgtgcattgcagttggcatggtaacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagtcgaggactatgggtttggaatcttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaactggattttgacttgtgtgaaggtaccacagttgttgtggatgaacattgtggaaatcgaggcccatctctcagaactacaacggtcacaggaaagataatccatgaatggtgttgcagatcctgcacgttaccccccttacgcttcagaggagaagacggatgttggtatggcatggaaatcagaccagtaaaggagaaggaggagaatctagttaggtcgatggtctctgcagggtcaggagaagtggacagtttttcactgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggccactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccatcaatgaaggaattatggctattggaatagtcagcattctactgagttcactcctcaaaaatgatgtgccgttggccgggccactaatagctggaggcatgctaatagcatgttacgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaggcaactttgctggcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagctatagctctagattttaaacccggcacatctggatctcccatcgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcaggaaaaacaaggagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcccgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccaaaaaacaaaaaacaatgattgggactatgtcgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaacaacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactcggacagaaggtggtgctttgatggggaaaggaacaaccaggtgttggaggagaacatggacgtggagatttggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttttagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgttgctcattccagagccagacagacagcgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttaatgcggaccacatgggccttgtgtgaatccatcacactggcgactggacccctgaccactctctgggagggatctccaggaaaattctggaatacaacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggatttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttaactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccattttcaccagctgatcatgaaggatgggagggaaatagtggtgccatgccgcaaccaagatgagcttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtag

SEQ ID NO: 5490 - RNA, 9879 nt, synthetic construct
  misc_feature 1..9879: note = derived and/or modified CDS sequence (wt) from DENV-1__KJ189368__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacttgggtgacctatgggacgtgttctcaaaacggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccatcttgcgcaaactgtgcattgaagccaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggttggactttaatgagatggtgctattgacaatgaaagaaaaatcatggcttgtccacaaacaatggtttctagacttaccactgccttggacttcgggggcttcaacatcccaagagacctggaacagacaagatttgctagtcacatttaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggcccatttaagctagagaaggaagtggctgagactcagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgataaccaaagagcgtggaacatttgggaagttgaggactatgggtttggaattttcacgacaaacatctggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgtagatcctgcacgttaccccccctacgtttcagaggagaagacggatgttggtatggcatggaaattagaccagtaaaggagaaggaggagaatctagttaggtcaatggtctctgcagggtcaggagaagtggacagtttttcattaggaatactatgcgtatcaataatgattgaagaggtgatgagatctagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggttattatttcgcagactaacatccagagaagttcttcttctcacgattggattgagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggccccttaatgaaggaattatggctattggaatagttagcatcctactaagttcactcctaaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctcctgaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggaaatagttgacctcatgtgccacgccacctttaccatgcgtctcttatccccagtgagagttcccaattacaacatgatcatcatggacgaagcacattttaccgatccagccagcatagcggccagagggtacatctcaacccgagtgggcatgggtgaagcagctgcgatctttatgacagccactcccccaggatcagtggaggcctttccacagagcaatgcagttatccaagatgaggaaagagacattcctgagagatcatggaactcaggctacgactggatcactgattttccaggcaaaacagtctggtttgtcccaagtattaaatcaggaaatgacattgctaactgtttaagaaagaacggaaaacgggtaattcaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcattccagccctctttgagccagagagagaaaagagtgcagcaatagacggggagtacagactgcggggagaagcaaggaaaacgttcgtggagctcatgagaagaggagatctaccagtttggctgtcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagcatctcaggtgacctaatattggaaatagggaaacttccacaacatttgacgttaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgcttattccagagccagacagacagcgcactccacaggacaaccagctggcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctactcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatcaccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacaattaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggagcctatcccaatggcgacctatggatggaacctagtaaagctacactctggaaaagacgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaatatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaattcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaactggaaacccccaatctagctgagagagtttttgactggttagaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagctgtcccagttgactgggtcccaaccagccgcacaacttggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5491 - RNA, 9879 nt, synthetic construct
  misc_feature 1..9879: note = derived and/or modified CDS sequence (wt) from DENV-1__KJ189369__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggtgaacaccgacgagacaaacgttccgtggcactggccccacacgtgggtcttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagactcagcatggaactgttctagtgcaggtcaaatacgaaggaacagacgcgccatgtaagatccccttttcgacccaagatgagaaaggggtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaagggagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggctgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccctgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacgacagtcacaggaaagataatccatgaatggtgttgcagatcctgcacgttacccccattacgtttcagaggagaagacggatgttggtatggcatggaaatcagaccagtaaaggagaaggaggagaatctagttaggtcaatggtctctgcagggtcaggagaagtggacagtttttcattaggaatactatgtgtatcaataatgattgaagaagtgatgagatccagatggagtagaaagatgctgatgactggaacactggctgttttcctccttcttgtaatgggacaactgacatggaatgatctgattaggttatgcatcatggttggagctaatgcttcagacaggatggggatgggaacaacgtacctagccttgatggctactttcaaaatgagaccaatgttcgctgttgggttattatttcgcagactaacatccagggaagttcttcttctcacgattggattaagcttggtggcatctgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacattccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggttccaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtgggacctacgtcagtgccattgcccaagctaaggcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcttctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcatcatggatgaagcacattttaccgatccagccagcatagcggccagagggtacatctcaacccgagtgggcatgggtgaagcagctgcgatcttcatgacagccactcccccaggatcggtggaggcctttccacagagcaatgcagtcatccaagatgaggaaagagacattcctgagagatcatggaactcaggctacgattggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcactggacagaagcaaaaatgctccttgacaatataaacacaccagaagggatcatcccagccctctttgagccagagagagaaaagaatgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagttcaaagagtttgcagcaggaagaagaagtgtctcaggtgacctaatattggaaatagggaaacttccacaacatttgacgttaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcgctgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccaccctttgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacaattaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttgaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggaattcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgaaatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagattggcggctaacgctatttgttcagctgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5492 - RNA, 9879 nt, synthetic construct
  misc_feature 1..9879: note = derived and/or modified CDS sequence (wt) from DENV-1__EU482615__SS-prME
  source 1..9879: mol_type = other RNA
tccgtgaccatgcttctcatgctactgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacacagacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccgccttttggtgagagctacatcgtggtaggggcaggtgaaaaagctttaaaactaagctggttcaagaaaggaagtagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaagcagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgtcacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaatactacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagagtgagagtgatcccgaaggggcactctggtga

SEQ ID NO: 5493 - RNA, 9879 nt, synthetic construct
  misc_feature 1..9879: note = derived and/or modified CDS sequence (wt) from DENV-1__EU482616__SS-prME
  source 1..9879: mol_type = other RNA
tccgtgaccatgcttctcatgctgctgcccacagccctggcgttccatttgaccacacgagggggagagccacacatgatagttaataagcaggaaagaggaaagtcactcttgtttaagacctccgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccatactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtctttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgccccgatgaccaaagagcgtggaacatttgggaagttgaggactatgggtttggaattttcacgacaaacatatggttgaaattgcgtgactcctacacccaaatgtgtgaccaccggcttatgtcagctgccatcaaggacagcaaggcagtccatgctgacatggggtactggatagagagtgaaaagaacgaaacctggaagctggcgagagcctccttcatagaagtcaagacatgcacctggccgaaatctcacactctatggagcaacggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggcccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacttagccttgatggctactttcaaaatgagaccaatgttcgctgttgggctattatttcgcagactaacatccagagaagttcttcttctcacgattggattaagcttggtggcatccgtggaactaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagaaggatgacacactcactatactccttaaagcaactttgctggcagtctcaggagtgtacccaatgtcaataccagcgactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaaaactcctgaaggtgaagttggagccatagctctagattttaaacccggcacatctggatctcccatcgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggagagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgctgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacctatcccaatggcgacctatggatggaacctagtaaagctacactctggaaaagatgtattttttatgccacccgagaaatgtgacacccttctgtgtgatattggtgagtcctctccgaatccaactatagaagaaggaagaacgttacgtgttttaaaaatggtggaaccatggctaagaggaaaccaattttgcataaaaatcctaaatccttacatgccaagtgtggtagaaactctggagcaaatgcaaagaaaacatggagggatgctagtgcgaaacccactctcaagaaattccacccatgaaatgtactgggtatcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttattcccatggtcacacaaatagccatgaccgataccacaccctttggacaacagagagtgtttaaagagaaagttgacacgcgcacaccaagagcaaaacgaggcacaacacaaattatggaggtgacagccaagtggttatggggtttcctctccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 5494 - RNA, 9879 nt, synthetic construct
  misc_feature 1..9879: note = derived and/or modified CDS sequence (wt) from DENV-1__EU482618__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtccctaacattcatcaaaacaactctttcattggattatgcatggaaaacaacggctatggcactgtcgatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcagctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggtaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgctgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggatgtagacctacgtccagcttcagcctggactctttatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagctaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5495 - RNA, 9879 nt, synthetic construct
  misc_feature 1..9879: note = derived and/or modified CDS sequence (wt) from DENV-1__EU482619__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacatttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggtatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactctgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggggttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgaaagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactcagatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggagaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccactcatgaaatgtactgggtttcatgtggaacaggaaacattgtgtcggcagtgaacatgacatccagaatgttactgaatcgattcacaatggctcacaggaagccaacatacgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcattgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgagaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatttagattatatgacatcaatgaagagattcaagaatgagagtgatcccgaaggggcactctggtga

SEQ ID NO: 5496 - RNA, 9879 nt, synthetic construct
  misc_feature 1..9879: note = derived and/or modified CDS sequence (wt) from DENV-1__FJ898433__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgacagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgaaatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgctgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagttaacattgagacagaaccaccttttggtgagagctacatcgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgactcgtgtgaaggtaccacagtcgttgtggatgaacattgtggaaatcgaggtccttctctcagaaccacaacagtcacaggaaagataatccatgaatggtgttgcagatcctgcacgttacctcccttacgtttcagaggagaagacggatgttggtatggcatggaaatcagaccagtaaaggagaaggaggagaatctagttaggtcaatggtctctgcaggttcaggagaagtggacagtttttcattaggaatactatgcgtatcaataatgattgaagaagtgatgagatccagatggagtagaaagatgctgatgactggaacactggctgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaattccatccacaccagttatggaccaccttactgtctctgacattcatcaaaacaactctatcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagctggcccctcaatgaaggaattatggctattggaatagttagcattctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaagatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagtcgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcacagattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagctggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgtttgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggagatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgtttttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggaggcatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaaaagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgacaccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacacgctcttttggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttgggaaaacatggtgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgaaagaaactgcttgcctaggcaagtcatatgcacaaatgtggcagctgatgtacttccacaggagagacctgagactggcggctaacgctatctgttcagccgtcccagttgattgggtcccaaccagtcgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagactatatgacatcaatgaagagattcaagaatgagagtgatcccgaaggggcactctggtga

SEQ ID NO: 5497 - RNA, 9879 nt, synthetic construct
  misc_feature 1..9879: note = derived and/or modified CDS sequence (wt) from DENV-1__FJ547088__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgtttttctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcccttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaacagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgggagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5498 - RNA, 9879 nt, synthetic construct
  misc_feature 1..9879: note = derived and/or modified CDS sequence (wt) from DENV-1__FJ810419__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacgtgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggccactttcaaaatgagaccaatgttcgctgttgggctattgtttcgcagactaacgtccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcgatcgtatctctctttcctttatgcctgtccacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcaccatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggtgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgatttcccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctataggcatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactaggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatacacaaaaggaggacctggacatgaggaacctatcccaatggcgacctatggatggaacttagtaaagctatactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaagacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttttggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctgggcaagtcatatgcacaaatgtggcagctgatgtacttccataggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5499 - RNA, 9879 nt, synthetic construct
  misc_feature 1..9879: note = derived and/or modified CDS sequence (wt) from DENV-1__FJ547068__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttttagacttaccactgccttggacttcgggggcttcaacatcccaagagacctggaacagacaagatttgctggtcacattcaagacagctcatgcaaagaaacaggaagtagtcgtactgggatcacaggaaggagcaatgcatactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaagatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggcggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatctttcggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttgtgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaatacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttgagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactacggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaatatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccattacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccaaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5500 - RNA, 9879 nt, synthetic construct
  misc_feature 1..9879: note = derived and/or modified CDS sequence (wt) from DENV-1__FJ562104__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggttgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcgcctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcattgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagcggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5501 - RNA, 9879 nt, synthetic construct
  misc_feature 1..9879: note = derived and/or modified CDS sequence (wt) from DENV-1__GQ199857__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaacagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagccgtgttcattgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttgtcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5502 - RNA, 9879 nt, synthetic construct
  misc_feature 1..9879: note = derived and/or modified CDS sequence (wt) from DENV-1__GQ199858__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaacagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacttggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaatcatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5503 - RNA, 9879 nt, synthetic construct
  misc_feature 1..9879: note = derived and/or modified CDS sequence (wt) from DENV-1__GQ199859__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacttgaaatgcagactaaaaatggataaattgactttaaaggggacgtcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggggttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtgtctctctttcctttatgcctgtctacgacctcccaaaaaacaacatggcttccggtgctgttaggatcttttggatgcaaaccattaaccatgtatcttataacagaaaacaaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcaggaaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacgatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttggggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccattacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgctacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5504 - RNA, 9879 nt, synthetic construct
  misc_feature 1..9879: note = derived and/or modified CDS sequence (wt) from DENV-1__JF937645__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaacagagactttgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgcttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctcgtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtgcaccaggtttttggaaccgcgtatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggctcaaggaaaaaaaatgattaggccacaacccatggaacacaaatactcatggaaaagctggggaaaagctaaaatcataggagcagatatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccaaaatctcacactctatggagcaacggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaaaataatccatgaatggtgttgcagatcctgcacgttaccccccttacgtttcagaggagaagacggatgttggtacggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacaattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagtattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatctgatctcatatggaggaggttggaggtttcaaggatcatggaacacgggggaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacatacctgagagatcatggaactcaggctacgactggatcactgattttccaggtaaaacagtctggttcgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgaccagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaatcaggtattagaggagaacatggacgtggagatctggacaaaggaaggagaaaggaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggaccctgtggtttatgatgcaaaatttgaaaaacagctaggccaaataatgttactgatactttgtacatcacagattctcttgatgcggaccacatgggccttgtgtgaatccatcacactggctactggacccctgaccactctctgggagggatctccaggaaaattctggaataccacgatagcagtgtccatggcaaacatcttcaggggaagttatttagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacacgcagtgtcgagagggacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgtcatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtctaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggccaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagtgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacttgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5505 - RNA, 9879 nt, synthetic construct
  misc_feature 1..9879: note = derived and/or modified CDS sequence (wt) from DENV-1__FJ850114__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatctatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgtgtcactaccatggcaaaaaataaaccaaccttggacattgaactcttgaagacggaggtcacgagccctgccatcttgcgcaaactgtgcattgaagctaaaatatcaaacaccaccaccgattcaagatgcccaacacaaggagaggctacattggtggaagaacaagacgcgaactttgtgtgtcgccgaacatttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagtatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacacgtcttgagaacatcatgtggaagcaaatatcaaatgaattgaaccacattctacttgaaaatgacatgaaattcacagtggttgtaggagatgctaatggaattttggcccaagggaaaaagatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagacatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggccgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggaactaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggttacgactggatcactgattttccaggtaaaacagtctggtttgtcccaagtattaaatcaggaaatgacattgctaactgcctaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaattctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacgccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacatcatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgatatcaatgaagagattcaagaatgagagcgatcccgaaggggcactctggtga

SEQ ID NO: 5506 - RNA, 9879 nt, synthetic construct
  misc_feature 1..9879: note = derived and/or modified CDS sequence (wt) from DENV-1__JN819402__SS-prME
  source 1..9879: mol_type = other RNA
tccgtgaccatgcttctcatgctactgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacacagacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactaggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccgccttttggtgagagctacatcgtggtaggggcaggtgaaaaagctttaaaactaagctggttcaagaaaggaagtagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaagcagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgtcacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaatactacgatagcagtgtccatgacaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagactgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagactaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagagtgagagtgatcccgaaggggcactctggtga

SEQ ID NO: 5507 - RNA, 9879 nt, synthetic construct
  misc_feature 1..9879: note = derived and/or modified CDS sequence (wt) from DENV-1__FJ850113__SS-prME
  source 1..9879: mol_type = other RNA
tccgtgaccatgcttctcatgctactgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacacagacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccgccttttggtgagagctacatcgtggtaggggcaggtgaaaaagctttaaaactaagctggttcaagaaaggaagtagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaagcagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgtcacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaatactacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagactaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagagtgagagtgatcccgaaggggcactctggtga

SEQ ID NO: 5508 - RNA, 9879 nt, synthetic construct
  misc_feature 1..9879: note = derived and/or modified CDS sequence (wt) from DENV-1__JF937635__SS-prME
  source 1..9879: mol_type = other RNA
tccgtgaccatgctcctcatgctgatgcccacagccctggcgttccatttgaccacacgggggggagagccacacatgatagttagtaagcatgaaagaggaaaggcactcttgtttaagacctctacaggtgtcaacatgtgcactctcattgcgatggacttgggagagttatgtgaggacacaatgacctacaaatgtccccggattactgaggcggaaccagatgatgttgactgctggtgcaatgccacagacacatgggtgacctatgggacgtgttcacaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacttgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattagaccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacttgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcttgggaacaagaagcagaacactcaggtacctcacacaacatattagtagaggtccaagatgatggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggtagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggcgaagtcggagccatagctctagattttaaacccggcacatctggatctcccatcgtgaacagagagggaaaaatagtaggtctttatggaaatggagtggtgacaacaagtggaacctacgtcagtgccattgctcaagctaaaacatcacaggaagggcctccaccagagattgaggacgaggtgttcaagaaaagaaacttaacaataatggacctgcatccaggatcaggaaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacaacgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtacgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaaatggttgtggggtttcctctccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttacggcttaaatactttcaccaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5509 - RNA, 9879 nt, synthetic construct
  misc_feature 1..9879: note = derived and/or modified CDS sequence (wt) from DENV-1__FJ024483__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgctggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctgttgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgataaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgtattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataataccaaagatatatggaggaccaatatctcagcacaactatagaccagggtattacacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatccctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttgtcattggagaaagcggctgaggtgtcctgggaacaagaggcagaacactccggtacctcacacaacatactagtagaggtccaagatgatggaaccatgaaaataaaagatgaagagagggatgacacactcactatactccttaaagctactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcactaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcccctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggcttccagtactccgacagaaggtggtgctttgatggggaaaggaacaaccaggtgttggaggagaacatggacgtggagatctggacaaaggaaggagaaaggaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccactggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggctgctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttgcgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactttcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaggcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcattcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattagaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5510 - RNA, 9879 nt, synthetic construct
  misc_feature 1..9879: note = derived and/or modified CDS sequence (wt) from DENV-1__EU596504__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggctctggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgctttgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccctgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactaggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatacacaaaaggaggacctggacatgaggaacctatcccaatggcgacctatggatggaacctagtaaagctatactctggaaaagatgtattttttatgccacctgagaaatgtgacacccttctgtgtgatattggtgagtcctctccgaatccaactatagaagaaggaagaacgttacgtattttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttttggagttcgaagcccttggtttcatgaatgaagatcactggtttagcagagagaattcactcagtggagtggaaggagaaggactgcacaaacttggatatatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5511 - RNA, 9879 nt, synthetic construct
  misc_feature 1..9879: note = derived and/or modified CDS sequence (wt) from DENV-1__FJ024481__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggctctggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccctgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactaggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatacacaaaaggaggacctggacatgaggaacctatcccaatggcgacctatggatggaacctagtaaagctatactctggaaaagatgtattttttatgccacctgagaaatgtgacacccttctgtgtgatattggtgagtcctctccgaatccaactatagaagaaggaagaacgttacgtattttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttttggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5512 - RNA, 9879 nt, synthetic construct
  misc_feature 1..9879: note = derived and/or modified CDS sequence (wt) from DENV-1__GQ199872__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcaccaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagccgccatcaaggacagcaaggcagtccatgctgacatggggtactggatagaaagtgaaaagaacgaaacctggaagctggcgagagcctccttcatagaagtcaagacatgcacctggccgaaatctcacactctatggagtaatggagttttggaaagtgaaatgataatcccaaagatatatggaggaccaatatctcagcacaactatagaccagggtacttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctaaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggagggggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtaaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagcattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagctggaccaatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaagacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcttaaatccttacatgccaagtgtggtagaaactctggagcaaatgcaaagaaaacatggagggatgctagtgcgaaacccgctctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcttcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggccacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagatcatatgacatcaatgaagagattcaagaatgagagtgatcccgaaggggcactctggtga

SEQ ID NO: 5513 - RNA, 9879 nt, synthetic construct
  misc_feature 1..9879: note = derived and/or modified CDS sequence (wt) from DENV-1__FJ410290__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgagccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctcgaacagggctggactttaatgagatggtgctattgacaatgaaagaaaaatcatggcttgtccacaaacaatggtttctggacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggagcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtattggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaaccacaacagtcacaggaaagataatccatgaatggtgttgcagatcctgcacgttacctcccttacgtttcagaggagaagacggatgttggtatggcatggaaatcagaccagtaaaggagaaggaggagaatctagttaggtcaatggtctctgcagggtcaggagaagtggacagtttttcattgggaatactatgcgtatcaataatgattgaagaagtgatgagatccagatggagtagaaagatgctgatgactggaacactggttgttttcctccttcttataatgggacaactgacatggaaagatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaagaaaaagctggcccctcaatgaaggaattatggctattggaatagttagcattctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgtttcacacaatgtggcacgtcaccaggggagctgtccttatgtaccaagggaagaggctggaaccaagctgggccagtgtaaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggagatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgtttttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagattcgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggaggcatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtagcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgaaattgctcacaaaaccatgggatgttatccccatggtcacacaaatagctatgaccgacaccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctataacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttgggaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcgactaatgctaaatgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaggagattcaagaatgagagtgatcccgaaggggcactctggtga

SEQ ID NO: 5514 - RNA, 9879 nt, synthetic construct
  misc_feature 1..9879: note = derived and/or modified CDS sequence (wt) from DENV-1__FJ024423__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtggtagccttttttttagcacatgccataggaacatccatcactcagaaagggatcattttcattttgctgatgctggtgacaccatcaatggccatgcgatgcgtgggaataggcaacagagactttgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactatttggaaagggaagcctattgacgtgtgccaagttcaagtgtgtgacaaaactagaaggaaagatagttcaatatgaaaacttaaaatattcagtgatagtcactgtccacactggggaccagcaccaggtgggaaatgagactacagaacatggaacaattgcgatcataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcattcaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtgataggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtctttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgccccgatgaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacttagccttgatggctactttcaaaatgagaccaatgttcgctgttgggctattattccgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagaaggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaaaactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgccatggaggaattaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaaaggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatccccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacctatcccaatggcgacctatggatggaacctagtaaagctacactctggaaaagatgtattttttatgccacccgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 5515 - RNA, 9879 nt, synthetic construct
  misc_feature 1..9879: note = derived and/or modified CDS sequence (wt) from DENV-1__FJ547089__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacatttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggtatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagacaatccatgaatggtgttgcagatcctgcacgttaccccccttacgcttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactctgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggggttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactcagatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggagaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggagtgcctgcacgtgaggaacctatccccatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccactcatgaaatgtactgggtttcatgtggaacaggaaacattgtgtcggcagtgaacatgacatccagaatgttactgaatcgattcacaatggctcacaggaagccaacatacgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcattgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgagaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5516 - RNA, 9879 nt, synthetic construct
  misc_feature 1..9879: note = derived and/or modified CDS sequence (wt) from DENV-1__FJ024484__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtggtagccttttttttagcacatgccataggaacatccatcactcagaaagggatcattttcattttgctgatgctggtgacaccatcaatggccatgcgatgcgtgggaataggcaacagagactttgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactatttggaaagggaagcctattgacgtgtgccaagttcaagtgtgtgacaaaactagaaggaaagatagttcaatatgaaaacttaaaatattcagtgatagtcactgtccacactggggaccagcaccaggtgggaaatgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcattcaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtgataggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtctttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgccccgatgaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacttagccttgatggctactttcaaaatgagaccaatgttcgctgttgggctattattccgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagaaggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaaaactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgccagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgccatggaggaattaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttcttcttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaaaggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgaccaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacctatcccaatggcgacctatggatggaacctagtaaagctacactctggaaaagatggattttttatgccacccgagaaatgtggcacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagatcccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 5517 - RNA, 9879 nt, synthetic construct
  misc_feature 1..9879: note = derived and/or modified CDS sequence (wt) from DENV-1__EU596503__SS-prME
  source 1..9879: mol_type = other RNA
tccgtgaccatgcttctcatgctgctgcccacagccctggcattccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaatttaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcataggctcatttaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggaatgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataacgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggacgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaaggaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacagggaggaaaagcctatagacatgccatggaggaactaccagacaccatagaaacattgatgcttctagctttgatagctgtgctgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggccatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5518 - RNA, 9879 nt, synthetic construct
  misc_feature 1..9879: note = derived and/or modified CDS sequence (wt) from DENV-1__FJ024479__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctataaatgcccccagatcactgaggcggaaccagatgacgttgactgctggtgtaacgccacagacacatgggtgacctatgggacgtgttctcaaaccggcgaacaccgacgagacaaacgttccgtggcactagccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgtttgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacctggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggtccagataccccagaatgccccgataaccaaagagcgtggaacatttgggaagttgaggactatgggtttggatttttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaacctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacagcggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaatatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgccagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgataatataaccacaccagaagggatcatcccagccctctttgagccagagagagaaaagagtgcagcaatagacggggagtccagactgcggggagaaccaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggccaaaggaaggagaaagaaagaaattgcgaccccgctggttggatgccagaacatactctgatccattggccctgggcgagtttaaagagtttggagcaggaagaagaagtggctcaggtgccctaatattggaaatagggaaacttccacaacatttgccgctaagagcccagaatggtctggataacttggtcatggtgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactcttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgccaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttggacatcacagatcctcttgatgcggaccacatgggccttgggtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagctaaactgaggtggtttgtggagaggaacctcgtgaacccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatcccccctgagaaatgtgacacccttctgtgtgatattggtgagtcctctccgaatccaactatagaagaaggaagaacgttacgtggtttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatggactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtggtcgttgatgaaaaccaatggaactcagcaaaagaagcaggggaagacgaaagggtttgggatctcggggacagagagagggagcttcataaacagggaaaatgtgccacgtgtggctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatacttagagacatatcaaagattccggggggaaatatgtatgcagatgatacagccgggtgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgcccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtggctttctggtcacaccatttccaccagctgatcatgaaggatgggagggaaatagtggtgccatgccgcaaccaagatgaacttgggggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5519 - RNA, 9879 nt, synthetic construct
  misc_feature 1..9879: note = derived and/or modified CDS sequence (wt) from DENV-1__FJ182002__SS-prME
  source 1..9879: mol_type = other RNA
tccgtgaccatgcttctcatgctgctgcccacagccctggcattccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataacgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggacccaaaccaaggaaggtgatcagtatgtttacatgggacagcctttaaataatgatgaggatcacgctcattggacagaagcaaaaatgctcctcgccaatataaacacaccagaagggatcatcccagccctctttgagccagagagagaaaagagtccagcaatagacggggagtacagactgcggggagaagcaaggaaaacgttcgtggagctcatgagaagaggagatctaccagtttggctgtcctataaagtagcctcagaaggtttccagtactccgacagaaggtggtggtttgatggggaaaggaacaaccaggtgttagaggagaacatggacgtggagatctggacaaaggaaggagaaagaaagaaattgcgaccccgctggttggatgccagaacatactctgatccattggccctgggcgagtttaaagagtttggagcaggaagaagaagtggctcaggtgacctaatattggaaatagggaaacttccacaacatttgacgctaagagcccagaatggtctggataacttggtcatggtgcacaattccgaacaaggaggaaaagcctatagacatgccatggaggaactaccagacaccatagaaacattgatgcttctagctttgatagctgtgctgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcaggggaagacgaaagggtttgggatctcgtggacagagagagggagcttcataaacagggaaaatggggcacggggggctacaacatgatggggaagagagagaaaaaactaggagagtttggaaaggcaaaaggaagtcgtggaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccgggtgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatgccaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctggtcacaccatttccaccagttgatcatgaaggatgggagggaaatagtggtgccatgccgcaaccaagatgaacttgtgggcagggctagagtatcacaaggcgctggatggagcctgagagaaactgcttggctaggcaagtcatatgcacaaatggggcagctgatgtacttccacaggagagacctgagactggcggctaacgctatctggtcagccggcccaggtgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5520 - RNA, 9879 nt, synthetic construct
  misc_feature 1..9879: note = derived and/or modified CDS sequence (wt) from DENV-1__FJ024482__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatcccctttttgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggattacggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcactcaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaggagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggccaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatggtgcacaattccgaacaaggaggaaaagcctatagacatgccatggaggaactaccagacaccatagaaacattgatgcttctagctttgatagctgtgttgactggtggagtgacgctgttcttcctatcaggaaaaggtttagggaaaacatccatcggcctgctctgtgtgacggcctcaagcgcactgttgtggatggccagtgtggagcctcattggatagcggcctccatcatactagagttctttttgatggtgctgcttattccagagccagacagacagcgcactccacaggacaaccagctagcatatgtggtgataggtttgttattcttgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctggactgaagaaagtcactgaagtgaagggatatacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccatacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgtcatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcattcagtggagtggaaggagaaggactgcacaaacttggatacatactcagagacatatcaaagattccggggggaaatatgtatgcagatgatacagccgggtgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaactgtgatggatgttatatccagacgtgcccagagaggaagtggccaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagctttaacagccctgaatgccatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5521 - RNA, 9879 nt, synthetic construct
  misc_feature 1..9879: note = derived and/or modified CDS sequence (wt) from DENV-1__EU596501__SS-prME
  source 1..9879: mol_type = other RNA
tccgtgaccatgcttctcatgctgctgcccacagccctggcgttccatttgacaacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcacccagaaagggatcattttcattttgctgatgctggtgacaccatcaatggccatgcgatgcgtgggaataggcaacagagacttcgttgaaggactgtcaggagcaacgtgggtggacgtggtattggagcatggaagctgtgtcactaccatggcaaaaaataaaccaaccttggacattgaactcttgaagacggaggtcacgaaccctgccatcttgcgcaaactgtgtattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttaaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctccttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacacttactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcatgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcttgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttactatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctgtcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacgtccagcttcagcctggactctctacgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagagggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattcctcccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcttcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtttacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgccctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaacgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagaatgagagtgatcccgaaggggcactctggtga

SEQ ID NO: 5522 - RNA, 9879 nt, synthetic construct
  misc_feature 1..9879: note = derived and/or modified CDS sequence (wt) from DENV-1__FJ898437__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggtatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagcaaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacagggaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactcagatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgttacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatacgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcattgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgagaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagagaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5523 - RNA, 9879 nt, synthetic construct
  misc_feature 1..9879: note = derived and/or modified CDS sequence (wt) from DENV-1__FJ024480__SS-prME
  source 1..9879: mol_type = other RNA
tccgtgaccatgcttctcatgctgctgcccacagccctggcattccatttgaccacacgagggggagagccacacatgatagttagtaagcaggaaagaggaaaatcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttctcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttgatggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtgtctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgaaattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatctccagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5524 - RNA, 9879 nt, synthetic construct
  misc_feature 1..9879: note = derived and/or modified CDS sequence (wt) from DENV-1__FJ873814__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtggtagccttttttttagcacatgccataggaacatccatcactcagaaagggatcattttcattttgctgatgctggtgacaccatcaatggccatgcgatgcgtgggaataggcaacagagactttgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactatttggaaagggaagcctattgacgtgtgccaagttcaagtgtgtgacaaaactagaaggaaagatagttcaatatgaaaacttaaaatattcagtgatagtcactgtccacactggggaccagcaccaggtgggaaatgagactacagaacatggaacaattgcgatcataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcattcaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtgataggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtctttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgccccgatgaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacttagccttgatggctactttcaaaatgagaccaatgttcgctgttgggctattattccgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaggcagaacactccggtacctcacacaacatactagtagaggtccaagatgatggaactatgaaaataaaagatgaagagaaggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaaaactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgccatggaggaattaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaaaggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatccccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaatctatcccaatggcgacctatgcatggaacctagtaaagctacactctggaaaagatgtattttttatgccacccgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 5525 - RNA, 9879 nt, synthetic construct
  misc_feature 1..9879: note = derived and/or modified CDS sequence (wt) from DENV-1__JN819403__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacacgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcattgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgagggacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 5526 - RNA, 9879 nt, synthetic construct
  misc_feature 1..9879: note = derived and/or modified CDS sequence (wt) from DENV-1__KF973453__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcactaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtccacgacctcccaaaaaacaacatggcttccggtgctgttaggatcttttggatgcaaaccgttaaccatgtttcttataacagaaaacaaaatctggggaaggaaaagttggccccttaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaatagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaactacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaagaaacaaccaggtgttggaggagaacatggacgtggagatctggacaaaggaaggagaaagaaagaaactgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggataaccagctagcatatgtggtgataggtttgttattcatgatactgacagtggcagccaatgagatggggttattggaaaccacaaagaaagacctggggattggccatgtagctgccgaaaaccatcaacatgctacaatgctggacgtagacctacgtccagcttcagcctggactctctatgcagtggccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggaacctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5527 - RNA, 9879 nt, synthetic construct
  misc_feature 1..9879: note = derived and/or modified CDS sequence (wt) from DENV-1__KF973454__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccattactcagaaagggatcattttcattttgctaatgctggtgacaccatcaatggccatgcgatgcgtgggaataggcaacagagacttcgttgaaggactgtcaggagcaacgtgggtggatgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtaggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtagtactgggatcacaggaaggagcaatgcacactgcgttgactggggcgacagaaatccagacgtcaggaacgacaacaatttttgcaggacacttgaaatgcagactaaaaatggataaattgactttaaaggggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctactcgaaaatgacatgaaattcacagtggttgtaggagatgctaatggaattttggcccaagggaaaaaaatgattaggccacaacccatggaacacaaatactcatggaaaagttggggaaaagctaaaatcataggagcagacatacaaaataccaccttcatcatcgacggcccagataccccagaatgccccgatgaccaaagagcgtggaacatttgggaagttgaggactatgggtttggaatttttacgactaacatatggctaaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatttgattaggttatgcatcatggttggagctaatgcttcagacaggatggggatgggaacaacgtacctagccttgatggctactttcaaattgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccactttactgtctctgacatttatcaaaacaactctttcactggattatgcatggaaaacaacggctatggcactgtcaatcgtgtctctctttcctatatgcctgtctacgacctcccaaaaaacaacatggcttccggtgctgttaggatcttttggatgcaaaccattaaccatgtatcttataacagaaaacaaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcagggaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctatgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcgatgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagagtgctctggataacttggtcatgttgcacaattccgaacaaggaggaaaagcctacagacatgctatggaggaactaccagacaccatagaaacattgatgcttctagctttgatagctgtgttgactggtggagtgatgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgcagaaaaccaccaacatgccacgatgctggacgtagacctacgtccagcctcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccttgaccactctctgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtagtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaacactttcactaatatggaggtccaactaataagacaaatggagtctgaaggaatctttttacccagcgaattggaaacccccaatctagctgagagagttcttgactggttggaaaaacatggcgccgaaaggctgaaaagaatggctatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggtactctggtaa

SEQ ID NO: 5528 - RNA, 9879 nt, synthetic construct
  misc_feature 1..9879: note = derived and/or modified CDS sequence (wt) from DENV-1__KF973455__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggatgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtaggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtagtactgggatcacaggaaggagcaatgcacactgcgttgactggggcgacagaaatccagacgtcaggaacgacaacaatttttgcaggacacttgaaatgcagactaaaaatggataaattgactttaaaggggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctactcgaaaatgacatgaaattcacagtggttgtaggagatgctaatggaattttggcccaagggaaaaaaatgattaggccacaacccatggaacacaaatactcatggaaaagttggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctaaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaattgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccactttactgtctctgacatttatcaaaacaactctttcactggattatgcatggaaaacaacggctatggcactgtcaatcgtgtctctctttcctatatgcctgtctacgacctcccaaaaaacaacatggcttccggtgctgttaggatcttttggatgcaaaccattaaccatgtatcttataacagaaaacaaaatctggggaaggaaaagttggcccatcaatgaaggaattatggctattggaatagtcagcattctactgagttcactcctaaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcagggaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgctacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctatgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcgatgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgatgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgcagaaaaccaccaacatgccacgatgctggacgtagacctacatccagcctcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccttgaccactctctgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtagtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaacactttcactaatatggaggtccaactaataagacaaatggagtctgaaggaatctttttacccagcgaattggaaacccccaatctagctgagagagttcttgactggttggaaaaacatggcgccgaaaggctgaaaagaatggctatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5529 - RNA, 9879 nt, synthetic construct
  misc_feature 1..9879: note = derived and/or modified CDS sequence (wt) from DENV-1__KF973456__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggatgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtaggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtagtactgggatcacaggaaggagcaatgcacactgcgttgactggggcgacagaaatccagacgtcaggaacgacaacaatttttgcaggacacttgaaatgcagactaaaaatggataaattgactttaaaggggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctactcgaaaatgacatgaaattcacagtggttgtaggagatgctaatggaattttggcccaagggaaaaaaatgattaggccacaacccatggaacacaaatactcatggaaaagttggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctaaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatttgattaggttatgcatcatggttggagctaatgcttcagacaggatggggatgggaacaacgtacctagccttgatggctactttcaaattgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccactttactgtctctgacatttatcaaaacaactctttcactggattatgcatggaaaacaacggctatggcactgtcaatcgtgtctctctttcctatatgcctgtctacgacctcccaaaaaacaacatggcttccggtgctgttaggatcttttggatgcaaaccattaaccatgtatcttataacagaaaacaaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcagggaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctatgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcgatgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgatgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgcagaaaaccaccaacatgccacgatgctggacgtagacctacgtccagcctcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccttgaccactctctgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtagtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaacactttcactaatatggaggtccaactaataagacaaatggagtctgaaggaatctttttacccagcgaattggaaacccccaatctagctgagagagttcttgactggttggaaaaacatggcgccgaaaggctgaaaagaatggctatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5530 - RNA, 9879 nt, synthetic construct
  misc_feature 1..9879: note = derived and/or modified CDS sequence (wt) from DENV-1__KF973459__SS-prME
  source 1..9879: mol_type = other RNA
tccgtgaccatgcttctcatgctgctgcccacagctctggcgttccatttgaccacacgagggggagagccacacatgatagttagtaagcaggaaagaggaaagtcactcttgtttaagacctctgcaggtgtcaatatgtgcactctcattgcgatggacttaggagagttatgtgaggacacactgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagtacaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcctcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgtacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaagtgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttatcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagctggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagagggctgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaacagagagggaaaaatagtaggtctttatggaaatggagtggtgacaacaagtggaacctacgttagtgccattgcccaagctaaagtatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggctggacgccagaacatactctgatccattggccctgcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgacacaaaatttgaaaaacagctaggccaaataatgttactgatactttgcacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacacgaggaacctatcccaatggcgacctatggatggaacctagtaaagctacactctggaaaagatgtatttttcatgccacctgagaaatgtgacacccttctgtgtgatattggtgagtcctctccgaatccaaccatagaagaaggaagaacgttacgtgttttaaaaatggtggaaccatggctaagaggaaaccaattctgcataaaaatcctaaatccttacatgccaagtgtggtagaaactctggagcagatgcaaagaaaatatggagggatgctagtgcgaaacccactctcaagaaattccacccatgaaatgtactgggtttcatgtggaacaggaaacattgtgtcggcagtgaacatgacatccagaatgctactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaggatcactggtttagcagagagaattcactcagtggagtggagggagaaggactgcacaaacttggatacatactcagagacatatcaaagattccggggggaaacatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtccgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5531 - RNA, 9879 nt, synthetic construct
  misc_feature 1..9879: note = derived and/or modified CDS sequence (wt) from DENV-1__KF973460__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatttttgcaggacacttgaaatgcagactaaaaatggataaattgactttaaaggggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgtttgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggattcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctaaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtctttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaattgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcactggattatgcatggaaaacaacggctatggcactgtcaatcgtgtctctctttcctttatgcctgtctacgacctcccaaaaaacaacatggcttccggtgctgttaggatcttttggatgcaaaccattaaccatgtattttataacagaaaacaaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcaggaaaaacaagaagatatcttccggccatagtccgtgaggccataaaaaggaagctgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtaagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacgatgctggacgtagacctacgtccagcctcagcctggactctctatgcagtagccacaacagttatcactcccatgatgagacacacaattgaaaatacaacggcaaacatctccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtatatcacaaattctcttgatgcggaccacatgggccttgtgtgaatccatcacactggcgactggacccttgaccactctttgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgactgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagagttatctagattacatgacatcaatgaagagattcaagaatgagagtgatcccgaaggggcactctggtaa

SEQ ID NO: 5532 - RNA, 9879 nt, synthetic construct
  misc_feature 1..9879: note = derived and/or modified CDS sequence (wt) from DENV-1__KF973461__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacagaggtcacgaacccagccattttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagtccaatatgaaaacttaaaatattcagtgatagtcactgtccatactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaggtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagttacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccatgggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacattatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgagttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaataacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaggttggagccatagctctagattttaaacccggcacatctggatctcctatcgtgaacagagagggaaaaatagtgggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggctttcccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatctccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtacgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacgtcacagatcctcttaatgcggaccacatgggccttgtgtgaatccatcacactagctactggacccctaaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagtaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcgcagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatctttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggagaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5533 - RNA, 9879 nt, synthetic construct
  misc_feature 1..9879: note = derived and/or modified CDS sequence (wt) from DENV-1__KF973462__SS-prME
  source 1..9879: mol_type = other RNA
tccgtgaccatgcttctcatgctgctgcccacagctctggcgttccatttgaccacacgagggggagagccacacatgatagttagtaagcaggaaagaggaaagtcactcttgtttaagacctctgcaggtgtcaatatgtgcactctcattgcgatggacttaggagagttatgtgaggacacactgacctacaaatgcccccagatcattgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagtacaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcctcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgtacaggctcatttaagctagagaaggaaatggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaagtgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagctggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagagggctgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaacagagagggaaaaatagtaggtctttatggaaatggagtggtgacaacaagtggaacctacgttagtgccattgcccaagctaaagtatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggctggacgccagaacatactctgatccattggccctgcgtgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgacacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgccgggctgaagaaagtcactgaagtgaagggatacacaaaaggaggacctggacatgaggaacctatcccaatggcgacctatggatggaacctagtaaggctacactctggaaaagatgtatttttcatgccacctgagaaatgtgacacccttctgtgtgatattggtgagtcctctccgaatccaaccatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagccatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaggatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtccgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaaataagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5534 - RNA, 9879 nt, synthetic construct
  misc_feature 1..9879: note = derived and/or modified CDS sequence (wt) from DENV-1__KF973463__SS-prME
  source 1..9879: mol_type = other RNA
tccgtaaccatgctcctcatgctgatgcccacagccctggcgttccatttgaccacacgggggggagagccacacatgatagttagtaagcatgaaagaggaaaggcactcttgtttaagacctctacaggtgtcaacatgtgcactctcattgcgatggacttgggagagttatgtgaggacacaatgacctacaaatgtccccggattactgaggcggaaccagatgatgttgactgctggtgcaatgccacagacacatgggtgacctatgggacgtgttcacaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaacaaaccaaccttggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagaccacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacttgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaaaatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaactggtacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattagaccacaacccatggaacacaaatactcatggaaaagctggggaaaagctaaaatcataggagcagacatacaaaataccaccttcatcatcgacggcccagataccccagaatgccccgatgatcaaagagcgtggaacatttgggaagttgaggactatgggtttggaattttcacgactaacatatggctgaaattgcgtgactcctacacccaaatgtgtgaccaccggttaatgtcagctgccatcaaggacagcaaggcagtccatgctgacatggggtactggatagaaagtgaaaagaacgaaacctggaagttggcgagagcctccttcatagaagtcaagacttgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagtcaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacaagatggggatgggaacaacgtacctagccttgatggccactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcttgggaacaagaagcagaacactcaggtacctcacacaacatattagtagaggtccaagatgatggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtattatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggcgaagtcggagccatagctctagattttaaacccggcacatctggatctcccatcgtgaacagagagggaaaaatagtaggtctttatggaaatggagtggtgacaacaagtggaacctacgtcagtgccattgctcaagctaaaacatcacaggaagggcctctaccagagattgaggacgaggtgttcaagaaaagaaacttaacaataatggacctgcatccaggatcaggaaaaacaagaagatatcttccggccatagtccgtgaggccataaaaaagaagctgcgcacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcccttgaataacgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacaacgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttatatgccaagtgtggtagaaactctggagcaaatgcaaagaaaacatggagggatgctagtacgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaaatggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaagggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttacggcttaaatactttcactaatatggaggtccaactaataagacaaatggagtctgaaggaatctttttacccagcgaattggaaacccccaacctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5535 - RNA, 9879 nt, synthetic construct
  misc_feature 1..9879: note = derived and/or modified CDS sequence (wt) from DENV-1__KF973464__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcactaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaattataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatgggatactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtccacgacctcccaaaaaacaacatggcttccggtgctgttaggatcttttggatgcaaaccgttaaccatgtttcttataacagaaaacaaaatctggggaaggaaaagttggccccttaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtatcttcaagactcctgaaggtgaagttggagccatagctctagattttaaacccggcacatctggatctcctatcgtgaatagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatggtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaagaaacaaccaggtgttggaggagaacatggacgtggagatctggacaaaggaaggagaaagaaagaaactgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggataaccagctagcatatgtggtgataggtttgttattcatgatactgacagtggcagccaatgagatggggttattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttaatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaattgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggaacctgaacatgctctattggctacgtcaatttttaagctgacttatcaaaacaaagtggtgagggtgcaaagaccagcaaaaaacggaaccgtgatggatgtcatatctagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagctgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5536 - RNA, 9879 nt, synthetic construct
  misc_feature 1..9879: note = derived and/or modified CDS sequence (wt) from DENV-1__KF973465__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacagaggtcacgaacccagccattttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagtccaatatgaaaacttaaaatattcagtgatagtcactgtccatactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaggtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagttacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccatgggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacattatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgagttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaggttggagccatagctctagattttaaacccggcacgtctggatctcctatcgtgaacagagagggaaaaatagtgggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggctttcccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggattatgttgtcacaacagacatctccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtacgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacgtcacagatcctcttaatgcggaccacatgggccttgtgtgaatccatcacactagctactggacccctaaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagtaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaatatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcgcagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatctttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggagaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5537 - RNA, 9879 nt, synthetic construct
  misc_feature 1..9879: note = derived and/or modified CDS sequence (wt) from DENV-1__KF973466__SS-prME
  source 1..9879: mol_type = other RNA
tccgtaaccatgctcctcatgctgatgcccacagccctggcgttccatttgaccacacgggggggagagccacacatgatagttagtaagcatgaaagaggaaaggcactcttgtttaagacctctacaggtgtcaacatgtgcactctcattgcgatggacttgggagagttatgtgaggacacaatgacctacaaatgtccccggattactgaggcggaaccagatgatgttgactgctggtgcaatgccacagacacatgggtgacctatgggacgtgttcacaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaacaaaccaaccttggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacttgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaaaatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaactggtacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggtcgtaggagatgctaatggaattttggcccaagggaaaaaaatgattagaccacaacccatggaacacaaatactcatggaaaagctggggaaaagctaaaatcataggagcagacatacaaaataccaccttcatcatcgacggcccagataccccagaatgccccgatgatcaaagagcgtggaacatttgggaagttgaggactatgggtttggaattttcacgactaacatatggctgaaattgcgtgactcctacacccaaatgtgtgaccaccggttaatgtcagctgccatcaaggacagcaaggcagtccatgctgacatggggtactggatagaaagtgaaaagaacgaaacctggaagttggcgagagcctccttcatagaagtcaagacttgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagtcaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacaggatggggatgggaacaacgtacctagccttgatggccactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcttgggaacaagaagcagaacactcaggtacctcacacaacatattagtagaggtccaagatgatggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtattatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggcgaagtcggagccatagctctagattttaaacccggcacatctggatctcccatcgtgaacagagagggaaaaatagtaggtctttatggaaatggagtggtgacaacaagtggaacctacgtcagtgccattgctcaagctaaaacatcacaggaagggcctctaccagagattgaggacgaggtgttcaagaaaagaaacttaacaataatggacctgcatccaggatcaggaaaaacaagaagatatcttccggccatagtccgtgaggctataaaaaggaagctgcgcacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcccttgaataacgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacaacgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctgggaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtacgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaaatggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaagggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttacggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtctggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcattgggaatgagaattatctagattacatgacatcaatgaagagattcaagaatgagagtgatcccgaaggggcactctggtaa

SEQ ID NO: 5538 - RNA, 9879 nt, synthetic construct
  misc_feature 1..9879: note = derived and/or modified CDS sequence (wt) from DENV-1__KF973471__SS-prME
  source 1..9879: mol_type = other RNA
tccgtgaccatgcttctcatgctgctgcccacagccctggcgttccatttgaccacacgagggggagagccacacatgatagttagtaagcaggaaagaggaaagtcactcttgtttaaaacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgctccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcactaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggcaatggctgtggactattcggaaagggaagcctattgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagactgataacagccaatcccatagtcactgacaaagaaaaaccagtcaacattgagactgaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatccgtgggaaaattggtacaccaggtttttggaaccgcatatggggttctgttcagcggtgtttcttggaccatgaaaataggaatagggattctgctgacatggctgggattaaattcaaggagcacgtcactttcgatgacgtgcatcgcagttggcatggttacactatacctaggagtcatggttcaagcggactcgggatgtgtgatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatggttttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacaccggctgttttcctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttagaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcatatctctctttcccttatgcctgtccacgacctcccaaaaaacaacatggcttccggtgctgttaggatcttttggatgcaaaccgttaaccatgtttcttataacagaaaacaaaatctggggaagaaaaagttggccccttaatgaaggaatcatggctatcggaatagttagcattctactaagttcactcctcaaaaatgatgtgccgttggccggcccactaacagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcaccatactccttaaagcaactttgctggcagtgtcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatttcatatggaggaggttggaggtttcaaggatcatggaacacgggagaagaagtgcaggtgatagctgttgaaccaggaaaaaaccccaaaaatgtacagacaacaccgggtaccttcaagactcctgaaggtgaagttggagccatagctctagattttaaacccggcacatctggatctcctatcgtgaatagagagggaaaaatagtaggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcttttccacagagcaatgcagtcatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtatcagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagaggagaggaagaattggaaggaaccaaaataaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaagaaacaaccaggtgttggaggagaacatggacgtggagatctggacaaaggaaggagaaagaaagaaactgcgaccccgctggttggacgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggaaccccattggatagcggcctccatcatactagagttctttctgatggtgctgcttattccagagccagacagacagcgcactccacaggataaccagctagcatatgtggtgataggtttgttattcatgatactgacagtggcagccaatgagatggggttattggaaaccacaaagaaagacctggggattggccatgtagctgccgaaaaccatcaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatacaaaatttgaaaaacagctaggccaaataatgttactgatactttgtacatcacagatcctcttaatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtatttttcatgccacctgagaaatgtgacacccttctgtgtgatattggtgagtcctctccgaatccaactgtagaagaaggaagaacgttacgtgttttaaaaatggtggaaccatggctaaaaggaaaccaattctgcataaaaatcctaaatccttacatgccaagtgtggtagaaactctggagcaaatgcaaagaaaatatggagggatgctagtgcgaaacccactctcaagaaactccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtaagattgctcacaaaaccatgggatgttatccccatggtcacacaaatagctatgaccgataccacaccctttggacaacagagagtgtttaaagagaaagttgatacgcgcacaccaagagcaaaacgaggcacaacacaaattatggaggtgacagccaagtggttatggggtttcctttccagaaacaaaaaacccagaatctgcacaagagaggagttcacaagaaaggttaggtcgaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggagggagaaggactgcacaaacttggatacatactcagagacatatcaaagattccggggggaaatatgtatgcagatgatacagccggttgggacacaagaataacagaggatgatcttcagaatgaggctaaaatcactgacatcatggaacctgaacacgctctattggctacgtcaatttttaagctgacttatcaaaacaaagtggtgagggtgcaaagaccagcaaaaaacggaaccgtgatggatgtcatatccagacgtgaccagagaggaagtggacaggtcggaacttatggcttaaatactttcactaacatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaactagtgggcagggctagagtatcacaaggcgccggatggagcctgagagaaactgcttgcctaggcaagtcatatgcacaaatgtggcagctgatgtacttccataggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaacccatgtatccagttgggaagaagttccatacctagggaaaagggaagatcaatggtgtggatccctgataggcttgacagcgagggccacctgggccactaacatacaagtggccataaaccaagtgagaagactcatcgggaatgagaattatctagattatatgacatcaatgaagagattcaagaatgagagtgatcccgaaggggcactctggtga

SEQ ID NO: 5539 - RNA, 9879 nt, synthetic construct
  misc_feature 1..9879: note = derived and/or modified CDS sequence (wt) from DENV-1__KF973472__SS-prME
  source 1..9879: mol_type = other RNA
tccgtgaccatgctcctcatgctgctgcccacagccctggcgttccatctgaccacacgggggggagagccacacatgatagttagtaagcatgaaagaggaaagtcactcttgtttaagacctctacaggtgtcaacatgtgcactctcatcgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccctggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtgctgggatcacaggaaggagcaatgcacactgcgttgactggggcgacagaaatccagacgtcaggaacgacaacaatttttgcaggacacttgaaatgcagactaaaaatggataaattgactttaaaggggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcagtgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctaaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacactgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaattgagaccaatgttcgctgttgggatattgtttcgcagactaacatccagagaagttcttctcctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcagaacaactctttcactggattatgcatggaaaacaacggctatggcactgtcaatcgtgtctctctttcctttatgcctgtctacgacctcccaaaaaacaacatggcttccggtgctgttaggatcttttggatgcaaaccattaaccatgtattttataacagaaaacaaaatctggggaaggaaaagttggcccatcaatgaaggaatcatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccgagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctatgtcagtgccattgctcaagctaaagcatcacaggaagggcctctaccagagattgaggacgaggtgttcaagaaaagaaacttaacaataatggacctgcatccaggatcaggaaaaacaagaagatatcttccggccatagtccgtgaggccataaaaaggaagctgcgcacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgccgaaaaccaccaacatgccacgatgctggacgtagacctacgtccagcctcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattcttttgatgcggaccacatgggccttgtgtgaatccatcacactggcgactggacccttgaccactctctgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtacgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagagttatctagattacatgacatcaatgaagaggttcaagaatgagagtgatcccgaaggggcactctggtaa

SEQ ID NO: 5540 - RNA, 9879 nt, synthetic construct
  misc_feature 1..9879: note = derived and/or modified CDS sequence (wt) from DENV-1__KF973474__SS-prME
  source 1..9879: mol_type = other RNA
tccgtgaccatgctcctcatgctgctgcccacagccctggcgttccatttgaccacacgggggggagagccacacatgatagttagtaagcatgaaagaggaaagtcactcttgtttaagacctctacaggtgtcaacatgtgcactctcattgcgatggacctgggagagttatgtgaggacacaatgacctacaaatgtccccggattactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggcattgagacacccaggattcacggtgatagccctttttttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaagtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtaggaaacgagactacagaacatggaacaattgcaaccataacacctcaagctcccacgtcggaaatacagctgactgactacggagccctcgcattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatttttgcaggacacttgaaatgcagactaaaaatggataaattgactttaaaagggacatcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtaacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgattccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctaaaattgcgtgactcctacacccaaatgtgtgaccatcggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgctggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagcaaatgcttcagacaggatggggatgggaacaacgtacctagccttgatggctactttcaaattgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccactttactgtctctgacatttatcaaaacaactctttcactggattatgcatggaaaacaacggctatggcactgtcaatcgtgtctctctttcctttatgcctgtctacgacctcccaaaaaacaacatggcttccggtgctgttaggatcttttggatgcaaaccattaaccatgtatcttataacagaaaacaaaatctggggaaggaaaagttggcccatcaatgaaggaattatggctattggaatagtcagcattctactgagttcactcctcaaaaatgatgtgccgttggctggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgagaataaaagatgaagagaaggatgacacactcactatactccttaaagcaactttgctagcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccattgtgaacagagagggaaaaatagtaggtctttatggaaatggagtggtgacaacaagtggaacctacgtcagtgccattgctcaagctaaagcatcacaggaagggcctctaccagagattgaggacgaggtgttcaagaaaagaaacttaacaataatggacctgcatccaggatcagggaaaacaagaagatatcttccggccatagtccgtgaggccataaaaaggaagctgcgtacgttaatcttggctcccacaagagttgtcgcctctgaaatggcagaggcgctcaagggaatgccagtaagatatcagacaacagcagtgaagagtgaacacacaggaagggagatagtagacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgcagaaaaccaccaacatgccacgatgctggacgtagacctacgtccagcctcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacctttgaccactctctgggagggatctccaggaaaattctggaataccacgatagcagtgtctatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaggcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaacactttcactaatatggaggtccaactaataagacaaatggagtctgaaggaatctttttacccagcgaattggaaacccccaatctagctgagagagttcttgactggttggaaaaacatggcgccgaaaggctgaaaagaatggctatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5541 - RNA, 9879 nt, synthetic construct
  misc_feature 1..9879: note = derived and/or modified CDS sequence (wt) from DENV-1__KF973475__SS-prME
  source 1..9879: mol_type = other RNA
tccgtaaccatgctcctcatgctgatgcccacagccctggcgttccatttgaccacacgggggggagagccacacatgatagttagtaagcatgaaagaggaaaggcactcttgtttaagacctctacaggtgtcaacatgtgcactctcattgcgatggacttgggagagttatgtgaggacacaatgacctacaaatgtccccggattactgaggcggaaccagatgatgttgactgctggtgcaatgccacagacacatgggtgacctatgggacgtgttcacaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgctaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaacaaaccaaccttggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggttgtggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatttttgcaggacacttgaaatgcagactaaaaatggacaaactgactttaaaggggacgtcatatgtgatgtgcacaggctcatttaagctagagaaggaagtggctgagacccaacatggaactgttctagtgcaggtcaaatacgaaggaacagacgcgccatgcaaaatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaactggtacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatggcatgaaattcacagtggttgtaggagatgctaatggaattttggcccaagggaaaaaaatgattagaccacaacccatggaacacaaatactcatggaaaagctggggaaaagctaaaatcataggagcagacatacaaaataccaccttcatcatcgacggcccagataccccagaatgccccgatgatcaaagagcgtggaacatttgggaagttgaggactatgggtttggaattttcacgactaacatatggctgaaactgcgtgactcctacacccaaatgtgtgaccaccggttaatgtcagctgccatcaaggacagcaaggcagtccatgctgacatggggtactggatagaaagtgaaaagaacgaaacctggaagttggcgagagcctccttcatagaagtcaagacttgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagtcaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacaggatggggatgggaacaacgtacctagccttgatggccactttcaaaatgagaccaatgttcgctgttgggatattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccatcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcttgggaacaagaagcagaacactcaggtacctcacacaacatattagtagaggtccaagatgatggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtattatgggacacacccagccctccggaagtggaaagagcagttcttgatgatggcatctatagaatcttgcaaagaggactgttgggcagatcccaagtgggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggcgaagtcggagccatagctctagattttaaacccggcacatctggatctcccatcgtgaacagagagggaaaaatagtaggtctttatggaaatggagtggtgacaacaagtggaacctacgtcagtgccattgctcaagctaaaacatcacaggaagggcctctaccagagattgaggacgaggtgttcaagaaaagaaacttaacaataatggacctgcatccaggatcaggaaaaacaagaagatatcttccggccatagtccgtgaggccataaaaaggaagctgcgcacgttaatcttggctcccacaagagttgtcgcctctgaaatggcagaggcgctcaagggaatgccaataagatatcagacaacagcagtgaagagtgaacacacaggaagggagatagtagaccttatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggctagtgctgcccagaggagaggaagaattggaaggaaccaaaacaaggaaggtgatcagtatgtttacatgggacagcccttgaataacgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtattccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacaacgcactccacaggacaaccagctagcatacgtggtgataggtttgttattcatgatactgacagtggcagccaatgagatgggattattggaaaccacaaagagagacctggggattggccatgtggccgccgaaaaccaccaacatgccacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgctatagacttggatcctgtggtttatgatgcaaaatttgaaaaacagctaggccaaataatgctactgatactttgtacatcacaaattctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtacgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaaatggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcatagagagagggagcttcataaacagggaaaatgtgccacgtgtgtctacaacatgatggggaagagagagaaaaaactaggagagtttggaaaggcaaagggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttacggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5542 - RNA, 9879 nt, synthetic construct
  misc_feature 1..9879: note = derived and/or modified CDS sequence (wt) from DENV-1__FJ898448__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 5543 - RNA, 9879 nt, synthetic construct
  misc_feature 1..9879: note = derived and/or modified CDS sequence (wt) from DENV-1__GQ868602__SS-prME
  source 1..9879: mol_type = other RNA
tctgtgaccatgctcctcatgctgctgcccacagccctagcgtttcatctgaccacccggggaggagagccgcacatgatagttagcaagcaggaaagaggaaaatcacttttgtttaagacctctgcaggtgtcaacatgtgtacccttattgcaatggatttgggagagttatgtgaggacacaatgacctataaatgccccaggatcactgagacggagccagatgacgttgactgttggtgcaatgccacggagacatgggtgacctatggaacatgttctcaaactggtgaacaccgacgagacaaacgttccgtcgcattggcaccacacgtagggcttggcctagaaacaagaaccgaaacgtggatgtcctctgaaggcgcttggagacaaatacaaaaagtggagacttgggctctgagacacccaggattcacggtgatagccctttttctagcacatgctataggaacatccatcacccagaaagggattatttttattctgctgatgctggtgactccatccatggccatgcggtgcgtgggaataggcaacagagacttcgtggaaggattgtcaggagctacgtgggtggatgtggtattggagcatggaagttgcgtcactaccatggcaaaagacaaaccaacactggacattgaactcctgaagacggaggtcacaaaccctgcagtcctgcgcaaactgtgcattgaagctaaaatatcaaacaccaccaccgattcgagatgtccaacacaaggagaagctacgctggtggaagagcaggacacgaactttgtgtgccgacgaacgttcgtggacagaggctggggcaatggctgtgggctattcggaaaaggtagcttaataacgtgtgctaagtttaagtgcgtgacaaaactggaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacaggactagactttaatgagatggtgttgttgacaatgaaagaaaaatcatggctcgtccacaaacaatggtttctggatctaccactgccttggacctcgggggcctcaacatcccaagagacttggaatagacaagacttgctggtcacatttaagacagctcatgcaaaaaagcaggaagtagtcgtactaggatcacaagaaggagcaatgcacactgcgctgactggagcgacagaaatccaaacgtctggaacgacaacaatttttgcaggacacctgaaatgcagactaaaaatggataaactgaccttaaaaggggtatcatatgtaatgtgcacagggtcattcaagctagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctaccttgtggtaggagcaggtgaaaaagctttgaaactaagctggttcaagaagggaagcagtatagggaaaatgttcgaagcaactgcccgtggagcacgaaggatggccatcctgggagacaccgcatgggacttcggttctataggaggggtgttcacgtctgtgggaaaactgatacaccagatttttgggactgcatatggagtcttgttcagcggggtttcttggaccatgaaaataggaatagggattctgctgacatggttaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatacaaattccaggccgactcccccaagagactatcagcggccatagggaaggcatgggaggagggtgtgtgtgggatccgatcagccactcgtctcgagaacattatgtggaagcaaatatcaaatgaattaaaccacatcttacttgaaaatgacatgaaatttacagtggtcgtaggagacgttaatggagtcttggcccaaggaaagaaaatgattaggccgcaacccatggaacacaaatactcgtggaaaagctggggaaaagccaaagtcataggagcagatgtacaaaatatcaccttcatcatcgacggcccaaacaccccagaatgccctgatgatcaaagagcatggaatatctgggaagtcgaagactatggatttggaatttttacgacaaacatatggttgaaattgcgtgactcctacactcaagtgtgtgaccaccggctaatgtcagccgccatcaaggatagcaaagcagtccacgctgacatgggatactggatagaaagtgaaaagaacgagacttggaagttgacaagagcctccttcatagaagttaagacatgcatctggccaaaatcccacaccctatggagcaatggagtcttggaaagtgagatgataatcccaaagatatatggaggaccaatatctcagcacaactacagaccaggatatttcacacaaacagcagggccgtggcacttgggcaagttagaactggattttggtttgtgtgaaggtaccactgttgttgtggatgaacattgtggaaatcgaggaccatctctaagaaccacaacagtcacaggaaagataatccatgaatggtgctgtagatcttgcacgttaccccccctacgtttcaaaggagaagacgggtgttggtacggtatggaaatcagaccagtcaaggagaaggaagagaacctagtcaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttcttataatgggacaattgacatggaatgatctgatcaggctatgtatcatggttggagccaatgcttcagacaagatggggatgggaacaacgtacctagctttgatggccactttcagaatgagaccaatgttcgcagtcgggctactgtttcgcagattaacatctagagaagttcttcttcttacagttggattgagtctagtggcatctgtagaactaccaaattccttggaggagctaggggatggacttgcaatgggcatcatgatgttgaaattactgactgattttcagtcacatcagctatgggctaccttgctgtctttaacatttgtcaaaacaactttttcactgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgagggaattatggctgttggaatagttagcattcttctaagttcacttctcaaaaatgatgtaccactagctggcccactaatagctggaggcatgctgatagcatgttatgtcatatctggaagctcggcggatttatcactggagaaagcggctgaggtctcctgggaagaagaagcagaacactctggtgcctcacacaacatactagtggaggtccaagatgacggaaccatgaagataaaagatgaagagagagatgacacacttaccattctcctcaaagcaactttgctagcaatctcaggggtatacccaatgtcaataccggcgaccctctttgtgtggtatttttggcagaagaagaaacagagatcaggagtgctatgggacacacccagccctccagaagtggaaagagcagttcttgatgatggcatctatagaattctccaaagaggactgttgggcaaatctcaagtaggagtaggagtttttcaagaaggtgtgttccacacaatgtggcacgtcaccaggggagctgtcctcatgtaccaagggaagagattggaaccaagttgggccagtgtcaaaaaagacttgatctcatatggaggaggttggaggtttcaaggatcctggaacatgggagaagaagtgcaggtgattgctgttgaaccggggaagaaccccaaaaatgtacagacagcgccgggtacctttaagacccctgaaggtgaagttggagccatagccctagactttaaacccggcacatctggatctcctattgtgaacagagagggaaaaatagtaggtctttatggaaatggagtggtgacaacaagtggaacctacgtcagtgccatagctcaagccaaagcatcacaagaagggcctctaccagagattgaggacgaggtgtttaggaaaagaaacttgacaataatggacctacatccaggatcgggaaaaacaagaagataccttccagccatagtccgtgaggctataaaaagaaagctacgcacgctagtcttagctcccacaagagttgtcgcttctgaaatggcagaggcgctcaagggaatgccaataaggtaccagacaacagcagtgaaaagtgaacacacgggaaaggagatagttgaccttatgtgtcacgccacttttaccatgcgtctcctctcccctgtgagagttcccaattataatatgattatcatggatgaagcacatttcactgatccggccagtatagcagccagagggtatatctcaacccgagtgggtatgggtgaagcagctgcaattttcatgacagccactccccccggatcgatggaggcctttccacagagcaatgcagctatccaagatgaggaaagagacattcctgaaaggtcttggaactcaggctatgactggattactgatttcccaggtaaaacagtttggtttgttccaagcatcaaatcaggaaatgacattgccaactgtttaagaaagaatgggaaacgggtggtccaattgagcagaaaaacctttgacactgagtaccagaagacaaaaaataacgactgggactatgttgtcacaacagacatatccgaaatgggagcaaacttccgagctgacagggtaatagacccaaggcggtgcctaaaaccggtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccatgcccattggacagaagcgaaaatgctccttgacaacataaacacaccagaagggattatcccagccctctttgagccggagagagaaaagagtgcagcaatagatggggaatacagactacggggtgaagcgaggaaaactttcgtggagcttatgagaagaggagatctacctgtttggctatcctacaaagttgcctcagaaggcttccagtattccgacagaaggtggtgctttgatggagaaaggaacaaccaggtgctgttgaagaacatggacgtggagatctggacaaaagaaggagaaagaaagaaactacgaccccgctggctggatgccagaacatactctgacccactggctctgcgcgagttcaaagagttcgcagcaggaagaagaagcgtctcaggtgacctaatattagaaatagggaaacttccacaacatctaacgcaaagggcccagaatgccttggacaacctggttatgctgcacaactctgaacagggaggaaaagcctatagacacgccatggaagaactaccagacactatagaaacgttaatgcttctggctttgatagctgtgctgactggtggggtgacgttgttcttcctatcaggaaggggtttagggaaaacatccattggtctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatattgacagtggcagccaatgagatgggattactggaaaccacaaagaaggacctagggattggtcatgtggctgctgaaagccaccatcatgctgcaatgctggacgtagacctacatccagcttcagcctggaccctctatgcagtggccacaacaattatcactcccatgatgagacacacaattgaaaacacaacggcaaacatttccctgacagctatcgcaaaccaggcagctatattgatgggacttgacaagggatggccaatatcaaagatggacataggagttccccttcttgccttggggtgctattctcaggtgaacccgctgacgctgacagcggcggtgttgatgctagtggctcattacgctataattggacccggactgcaagcaaaagctactagagaagctcaaaaaaggacagcagctggaataatgaaaaacccaactgtcgatgggatcgttgcaatagatttggaccctgtggtttacgatgcaaaatttgaaaaacagctaggccaaataatgctgttgatactttgcacatcacagattctcctgatgcggaccacatgggccttgtgtgaatccatcacactagccactggacctctgaccacactctgggagggatctccaggaaaattctggaacaccacgatagcggtgtccatggcaaatatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggatcatagaggtggatagatctgaagccaaagaggggttaaaaagaggagaaacgactaaacacgcggtgtcgagaggaacggccaaactgaggtggtttgtagagaggaaccttgtgaaaccagaagggaaagtcatagacctcggttgtggaagaggtggctggtcatattactgcgctgggctgaagaaagtcacagaagtgaaaggatacacgaaaggaggacctgggcatgaggaaccaattccaatggcaacctatggatggaacctagtaaaactatactccgggaaagatgtattctttacaccacctgagaaatgtgacacccttttgtgcgatattggtgagtcctctccgaacccaaccatagaagaaggaagaacgttacgagttctaaagatggtggaaccatggctcagaggaaaccaattttgcataaaagttctaaatccctatatgccgagcgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagaaatgtggcagtagaaccagaggtggccaacctagatatcattggccagaggatagaaaatataaaaaatgaacacaaatcaacatggcattatgatgaggataatccatacaagacatgggcctatcatggatcatatgaggtcaagccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacgcgcacaccaaaagcgaaacgaggcacagcacaaattatggaggtgacagccaggtggttatgggggtttctctctagaaacaaaaaacccagaatttgtacaagagaggagttcacaagaaaagtcaggtcaaacgcagccattggagcagtgttcattgatgaaaatcaatggaactcagcaaaagaggcagtggaagatgaacggttctgggaccttgtgcacagagagagggagcttcataaacaaggaaaatgtgccacgtgtgtttacaacatgatgggaaagagagagaaaaaattaggagagtttggaaaggcaaaaggaagtcgcgcaatatggtacatgtggttgggagcgcgttttttagagtttgaagcccttggtttcatgaatgaagatcactggttcagcagagagaattcacttagtggagtggagggagaaggactccacaaacttggatacatactcagagacatatcaaagattccagggggaaatatgtatgcagatgacacagccggatgggacacaagaataacagaggatgatcttcagaatgaggctaaaatcactgacatcatggaacctgaacatgccctactggccacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcaccaacatggaggcccaactaataagacaaatggaatctgagggaatctttttacccagcgaattggaaaccccaaatctagctgaaagagtccttgactggttggaaaaacatggcatcgagaggctgaaaagaatggcaatcagtggagatgactgtgtggtgaaaccaattgatgacagatttgcaacagccttaacagctttgaatgacatgggaaaggtaagaaaagacataccacaatgggaaccttcaaaaggatggaatgattggcaacaagtgcctttctgttcacaccatttccaccagctgatcatgaaggatgggagggagatagtggtgccatgccgcaaccaagatgaacttgtgggtagggccagagtatcacaaggcgccggatggagcctgagagaaactgcatgcctaggcaagtcatatgcacaaatgtggcagctgatgtacttccacaggagagacttgagattagcggctaatgctatctgttcagccgttccggttgattgggtcccaaccagccgcaccacctggtcgatccatgcccaccaccaatggatgacaacagaagacatgttgtcagtgtggaatagagtctggatagaggaaaacccatggatggaggacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagaatgatcctgaaggggcactctggtaa

SEQ ID NO: 5544 - RNA, 9879 nt, synthetic construct
  misc_feature 1..9879: note = derived and/or modified CDS sequence (wt) from DENV-1__KF921911__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgtaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggctacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcgcctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtgataggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtcagctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagctggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtagacagtttttcactagggatactatgcgtatcaataatgattgaagaagtgatgagatccagatggaatagaaagatgctgatgactggaacattggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattgagcctagtggcatccgtggagttaccaaattctttggaggagctgggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttagccggcccactaatagctggaggcatgctaatagcatgttatgtcatatctggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtacttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagtcttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaagtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggttacgactggatcactgattttccaggtaaaacagtctggtttgttccaagcattaagtcaggaaatgacattgctaactgcttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaattgatggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcctatgatgagacacacaattgaaaacacaacggcaaacatttccctgacagccattgcaaaccaggcagctatattgatgggacttgacaagggatggccaatatcgaagatggacataggagttccacttctcgccttagggtgctattcccaagtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccttgtgtgaatccatcacactggctactggacccttgaccactctctgggagggatctccaggaaaattttggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgacataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactaaatcgattcacaatggctcacaggaagccaacatatgaaagagacgtggacttaggcgctggaacaagacatgtggcagtggaacctgaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtggacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgtacagagagagggagcttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaatatgtatgcagatgacacagccggatgggacacaagaataacagaggatgatcttcagaatgaggctaaaatcactgacatcatggagcctgaacacgctctattggctacgtcgatttttaagctgacctaccaaaacaaggtggtaagggtgcaaagaccagcaaaaaatggaaccgtgatggatgttatatccagacgagatcagagaggaagtgggcaggtcggaacctatggcttaaatactttcaccaatatggaggtccaactaataagacaaatggagtctgaaggaatctttttacccagcgaactggaaacccccaatctagctgagagagttcttgactggttggaaaaacatggcaccgaaaggctgaaaagaatggcaattagcggagatgattgtgtggtgaaaccggttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcacgtgtccagctgggaagaagtcccatacttagggaaaagggaagatcaatggtgtggatccctgataggtttgacagcgagggccacttgggccactaacatacaagtagccataaaccaagtgagaaggctcatcgggaacgagaattatctagattacatgacatcaatgaagagattcaagaatgagagtgatcccgaaggggcactctggtaa

SEQ ID NO: 5545 - RNA, 9879 nt, synthetic construct
  misc_feature 1..9879: note = derived and/or modified CDS sequence (wt) from DENV-1__KJ189350__SS-prME
  source 1..9879: mol_type = other RNA
tccgtgaccatgctcctcatgctgcttcccacagccctggcgtttcatttgaccacacgagggggagagccacacatgatagttagtaagcaggagagaggaaagtcactcttgtttaagacctctgcgggcgtcaatatgtgcaccctcatagcgatggacttgggagagttatgtgaggacacaatgacctacaaatgcccccggatcactgaggcagaaccagatgacgttgactgctggtgcaatgccacagacacatgggtgacctatgggacgtgttctcaaaacggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgtgtcaccaccatggcaaaaaataaaccaacattggacattgaactcttgaagacagaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggggccctcacattggactgctcacctagaacagggctggactttaacgagatggtgctattgacaatgaaagaaaaatcatggcttgtccacaaacaatggtttctagacttgccactgccatggacttcgggggcttcaacatcccaagagacctggaacagacaagatctgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgataaagaaaaaccagtcaacattgagacagaaccaccttttggtgagagctacatcgtggtaggggcaggcgaaaaagctttgaaactaagctggttcaagagaggaagcagcataggaaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactctccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaatcttggcccaaggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctgggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacgggtgttggtatggcatggaaatcagaccagtgaaggagaaggaggagaatctagttaggtcaatggtctctgcaggatcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggcatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggtagctcagccgatttatcattggagaaagcggctgaagtatcctgggaacaagaagcagaacattccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagcttatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgctactagctttgatagctgtgttgactggcggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacatacaattgaaaatacaacggcaaacatttccctaaccgccattgcaaatcaggcagctatattgatgggacttgacaagggatggccaatatcgaagatggacataggagttccacttctcgctttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagtcactgaagtgaagggatacacaaaaggaggacctggacatgaagaacctatcccaatggcgacctatggatggaacctagtaaaactacactctggaaaggatgtattttttatgccacctgagaaatgtgacacccttctgtgtgatattggtgagtcctctccgaatccaaccatagaagaaggaagaacgttacgtgttctaaaaatggtggaaccatggctcagaggaaaccaattctgcataaaaatcttaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgtacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaagattttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagacgatacagccggatgggacacaagagtaacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5546 - RNA, 9879 nt, synthetic construct
  misc_feature 1..9879: note = derived and/or modified CDS sequence (wt) from DENV-1__KJ189351__SS-prME
  source 1..9879: mol_type = other RNA
tccgtgaccatgctcctcatgctgctgcccacagtcctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggatttacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcctgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggactccgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagattaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcaacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggagttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaaggctgtcagcagccattggaaaggcatgggaggagggcgtgtgtggaattcgatcagccacgcgtcttgagaacatcatgtggaagcagatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcattatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacggcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggatagtttttcattaggaatactatgtgtatcaataatgattgaagaagtgatgagatccagatggagtagaaagatgctgatgactggaacactggctgttttcctccttcttataatgggacaactgacatggaatgatctgactaggttatgcatcatggttggagctaatgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttatagcagaaaacagaatctggggaaggaaaagttggcccctcaatgaaggaattatggctattggaatagtcagcattctactaagctcactcctcaaaaatgatgtaccgttggccgggccactaatagctggaggcatgctgatagcatgttatgtcatatccggaagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagtccttgataatggcatctatagaatcttgcaaagaggactgttgggtaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggatctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtcaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggggaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggagcaaatttccgggccgacagggtaatagacccaaggcggtgcttgaaaccggtaatactaaaagatggtccagagcgtgtcattctagccggaccgatgccggtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaagaaggagaaagaaagaaattgcgacctcgctggttggacgccagaacatactctgatccattggccctgcgcgagttcaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcagggaaaggcctagggaaaacatctattggcttgctctgtgtgacggcctcaagcgcactgttatggatggccagtgtggagccccattggatagcggcctccatcatattggagttctttttgatggtgctgctcattccagagccagacagacaacgcactccacaggacaaccagctagcatatgtggtgataggtttgttattcatgatactgacagtggcagccaatgagatgggattactggaaaccacaaagaaagacctggggattggctatgtagccgccgaaaaccaccaacatgccacaatgctggacgtagacctacacccagcttcagcctggaccctctatgcagtagctacaacagtcatcactcctatgatgagacacacaattgaaaatacaacggcaaacatttccctgaccgccattgcaaaccaggcagctatattgatgggacttgacaagggatggccaatatcaaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacatctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattctttatgccacctgagaaatgtgacacccttctgtgtgatattggtgagtcctctccgaatccaactatagaagaaggaagaacgttacgtgttctaaaaatggtggaaccatggctcagaggaaaccaattctgcgtaaaaatcctaaatccttacatgccaagtgtggtagagactctggagcgaatgcaaagaaaacatggagggatgctagtgcgaaacccactctcaagaaattctacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagtcatcaggatcagcctcatctatggtgaatggagtggtgagattgcttacgaaaccatgggatgttatccccatggtcacacaaatagctatgactgataccacaccctttggacaacagagagtgtttaaagagaaagttgacacgcgcacaccaagagcaaaacgaggcacaacacagattatggaggtgaccgccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggccaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacagatggagtctgaaggaatctttttacccagcgaattggaaacccccaacctagctgagagggctcttgattggttagaaaaacatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcttgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggataaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5547 - RNA, 9879 nt, synthetic construct
  misc_feature 1..9879: note = derived and/or modified CDS sequence (wt) from DENV-1__KJ189352__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgtcttgagaacatcatgtggaggcagatatcaaatgaattgaaccacattttacttgagaatgacatgaaattcacagtggttgtaggagatgccaacggaattttggcccaaggaaaaaaaatgattaggccacaacccatggaacacaaatactcatggaaaagctggggaaaagctaaagtcataggagcagacatacaaaataccaccttcattatcgacggcccagacaccccagaatgtcctgatggccaaagagcatggaacatttgggaagttgaggactatgggtttggagttttcacgacaaatatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaaaacatgtacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattccttggaggagctaggggatggacttgcaatgggtatcatgatgttaaaattgttgactgaatttcagccacaccagttatggaccaccttattgtctctgacatttgtcaaaacaactctctcattggattatgcatggaaaacaactgctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcaccttcaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgacctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5548 - RNA, 9879 nt, synthetic construct
  misc_feature 1..9879: note = derived and/or modified CDS sequence (wt) from DENV-1__KJ189353__SS-prME
  source 1..9879: mol_type = other RNA
tccgtgaccatgctcctcatgctgcttcccacagccctggcgtttcatttgaccacacgagggggagagccacacatgatagttagtaagcaggagagaggaaagtcactcttgtttaagacctctgcgggcgtcaatatgtgcaccctcattgcgatggacttgggagagttatgtgaggacacaatgacctacaaatgcccccggatcactgaggcagaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgtgtcaccaccatggcaaaaaataaaccaacattggacattgaactcttgaagacagaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggggccctcacattggactgctcacctagaacagggctggactttaacgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggacaaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatataaattccaggctgactctccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaatcttggcccaaggaaaaaaaatgattaggccacaacccatggaacacaaatactcatggaaaagctggggaaaagctaaaatcataggagcggacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctgggtaagctggaactggattttgaattgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacgggtgttggtatggcatggaaatcagaccagtgaaggagaaggaggagaatctagttaggtcaatggtctctgcaggatcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggccatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggtagctcagccgatttgtcattggagaaagcggctgaagtatcctgggaacaagaagcagaacattccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagcttatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacatacaattgaaaatacaacggcaaacatttccctaaccgccattgcaaatcaggcagctatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaagaacctatcccaatggcgacctatggatggaacctagtaaaactacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcttaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgtacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaagattttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagacgatacagccggatgggacacaagagtaacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatctagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5549 - RNA, 9879 nt, synthetic construct
  misc_feature 1..9879: note = derived and/or modified CDS sequence (wt) from DENV-1__KJ189354__SS-prME
  source 1..9879: mol_type = other RNA
tccgtgaccatgctcctcatgctgcttcccacagccctggcgtttcatttgaccacacgagggggagagccacacatgatagttagtaagcaggagagaggaaagtcactcttgtttaagacctctgcgggcgtcaacatgtgcaccctcattgcgatggacttgggagagttatgtgaggacacaatgacctacaaatgcccccggatcactgaggcagaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgtgtcaccaccatggcaaaaaataaaccaacattggacattgaactcttgaagacagaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggggccctcacattggactgctcacctagaacagggctggactttaacgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgttcagcggtgtttcttggaccatgaaaatagggatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactctccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaatcttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctgggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacgggtgttggtatggcatggaaatcagaccagtgaaggagaaagaggagaatctagttaggtcaatggtctctgcaggatcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggtagctcagccgatttatcattggagaaagcggctgaagtatcctgggaacaagaagcagaacattccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagtttttcaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcctatccccagtgagagttcccaattacaacatgattattatggatgaagcgcattttaccgatccagctagcatagcggctagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagcttatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggagggaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacatacaattgaaaatacaacggcaaacatttccctaaccgccattgcaaatcaggcagctatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaagaaccaatcccaatggcgacctatggatggaacctagtaaaactacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcttaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgtacaccaagagcaaaacgaggcacaacacagatcatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaaattttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagacgatacagccggatgggacacaagagtaacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattatatgacatcaatgaagagattcaagaatgagagtgattccgaaggagcactctggtaa

SEQ ID NO: 5550 - RNA, 9879 nt, synthetic construct
  misc_feature 1..9879: note = derived and/or modified CDS sequence (wt) from DENV-1__KJ189355__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaagcgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttattgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcatgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcattatcgacggcccagacaccccagaatgtcctgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaaaacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgtttcacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcaccttcaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacgaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctactcatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggagccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgacctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgaaggaatctttttacccagcgaattggaaacccccaacctagctgagagggctcttggctggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcgatgaagagattcaagaatgagagtgattccgaaggagcactctggtaa

SEQ ID NO: 5551 - RNA, 9879 nt, synthetic construct
  misc_feature 1..9879: note = derived and/or modified CDS sequence (wt) from DENV-1__KJ189358__SS-prME
  source 1..9879: mol_type = other RNA
tccgtgaccatgctcctcatgctgctgcccacagtcctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacttatgggacgtgttctcaaaccggcgaacaccgacgagagaagcgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtgggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgttgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaaggctgtcagcagccattggaaaggcatgggaggagggcgtgtgtggaattcgatcagccacgcgtcttgagaacatcatgtggaagcagatatcaaatgaattgaaccacattctacttgagaatgacatgaaattcacagtggttgtaggagatgccaacggaatcttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccatcggctaatgtcagctgccatcaaggacagcaaggcagttcatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacggccgggccatggcatctaggtaagttggaactggattttgacttgtgtgaaggtaccacagttgttgtggatgaacattgtggaaaccgaggtccatctctcagaaccacaacagtcacaggaaagataatccatgaatggtgttgcagatcctgcacgctaccccccttacgtttcagaggagaagacggatgttggtatggcatggaaatcagaccagtgaaggagaaggaggagaatctagttaggtcaatggtctctgcagggtcaggagaagtggatagtttttcattaggaatactatgcgtatcaataatgattgaagaagtgatgagatccagatggagtagaaagatgttgatgactggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgtagggttattattccgcagactaacatccagagaagttcttctcctcacgattggattaagcctggtggcatccgtggagctaccaaattctttggaggagctaggggatggacttgcaatgggtatcatgatgttaaaattgttgactgaattccagccataccagttatggaccaccttattgtctctgacatttgtcaaaacaactctctcattggattacgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaagaatgatgtaccgttggccgggccactaatagctggaggcatgctaatagcatgttatgtcatatccggaagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttctggcagagaaagaaacagagatcaggagtgttatgggacacacccagccctccggaagtggaaagagcagttcttgataatggcatctatagaatcttgcaaagaggactgttgggcaggtcccaagtaggagtgggagtcttccaagacggcgtgttccacacaatgtggcacgttaccaggggagctgtcctcatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagccaaagcatcacaggaagggcctctaccagagattgaggacgaggtatttaagaaaagaaacttaacaataatggacctgcacccaggatcagggaaaacaagaaaatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaatatgattattatggatgaagcacattttaccgatccagctagcatagcggccagagggtacatctcaacccgagtgggtatgggtgaagcagctgcgatctttatgacagccactccccctggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggagcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaatacaccagaagggatcatcccagctctttttgagccagagagagaaaagagtgcagcaatagacggggagtacagactgcggggagaagcaaggaaaacgttcgtggagctcatgagaagaggagatctaccagtttggctatcctacaaagtagcttcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagataccatagaaacattgatgcttctagctttgatagctgtgttgactggtggagtgacgctgttcttcctatcagggaaaggcctagggaaaacatctattggcttgctctgtgtgacggcctcaagcgcactgttatggatggccagtgtggagccccattggatagcggcctccatcatactagagttctttttgatggtgctgctcattccagagccagacagacaacgcactccacaggacaaccagctagcatatgtggtgataggtttgttattcatgatactgacagtggcagccaatgagatgggattactggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcaaagatggacataggagttccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctatgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaatttaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagttacactctggaaaggatgtattttttatgccacctgagaaatgtgacacccttctgtgtgatattggtgagtcctctccaaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcttatcatggatcatatgaggtcaagccatcaggatcagcctcatctatggtgaatggagtggtgagattgctcacgaaaccatgggatgttatccccatggtcacacaaatagccatgactgacaccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgtacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctcaattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacagatggagtctgaaggaatctttttacccagcgaattggaaacccccaacctagctgagagggctcttgactggttagaaaaaaatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccattttcaccagctgatcatgaaggatgggagggaaatagtggtgccatgccgcaaccaagatgaacttgtgggcagggctagagtgtcacaaggcgccggatggagcttgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggataaaactcatgtatccagttgggaagaagttccatacctaggaaaaagggaagatcaatggtgtggatccctgataggcttgacagcgagggccacctgggccaccaacatacaagtagccataaaccaagtgagaaggctcattgggaatgagaattatttagattacatgacatcaatgaagagattcaagaatgagagtgattccgaaggagcactctggtaa

SEQ ID NO: 5552 - RNA, 9879 nt, synthetic construct
  misc_feature 1..9879: note = derived and/or modified CDS sequence (wt) from DENV-1__KJ189359__SS-prME
  source 1..9879: mol_type = other RNA
tccgtgaccatgctcctcatgctgctgcccacagtcctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggagttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaaggctgtcagcagccattggaaaggcatgggaggagggcgtgtgtggaattcgatcagccacgcgtcttgagaacatcatgtggaagcagatatcaaatgaattgaaccacattctacttgagaatgacatgaaattcacagtggttgtaggagatgccaacggaattttggcccaagggaaaaaaatgattaggccacaacccatggaacacaaatactcatggaaaagctggggaaaagccaaaatcataggagcagacatacaaaataccaccttcatcatcgacggcccagacaccccagaatgtcccgatggccaaagagcatggaacatttgggaagttgaggactatgggtttggagttttcacgacaaatatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacggcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggatagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgtagggctattattccgcagactaacatccagagaagttcttctcctcacgattggactaagcctggtagcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtaccgttggccgggccactaatagctggaggcatgctgatagcatgttatgtcatatccggaagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagagaaagaaacagagatcaggagtgttatgggacacacccagccctccggaagtggaaagagcagttcttgataatggcatctatagaatcttgcaaagaggactgttgggcaggtcccaagtaggagtgggagtcttccaagacggcgtgttccacacaatgtggcacgttaccaggggagctgtccttatgtaccaagggaaaagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtaaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggagcaaatttccgggccgatagggtaatagacccaaggcggtgcttgaaaccggtaatactaaaagatggtccagagcgtgtcattctagccggaccgatgccggtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggttttcagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagttcaaagagttcgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacatgctatggaggaactaccagacaccatagaaacattgatgcttctagctttgatagctgtgttgactggtggagtgacgctgttcttcctatcagggaaaggcctagggaaaacatctattggcttgctctgtgtgacggcctcaagcgcactgttatggatggccagtgtggagccccattggatagcggcctccatcatactagagttctttttgatggtgctgctcattccagagccagacagacaacgcactccacaggacaaccagctagcatatgtggtgataggtttgttattcatgatactgacagtggcagccaatgagatgggattactggaaaccacaaagaaagacctggggattggctatgtagccgccgaaaaccaccaacataccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcaaagatagacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtatatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatatacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgatttacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgttatccccatggtcacacaaatagctatgactgataccacacccttcggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaacacagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacagatggagtctgaaggaatctttttacccagcgaattggaaacccccaacctagctgagagggctcttgactggttagaaaaacatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcttgagagaaactgcttgcctaggcaagtcatatgcacaaatgtggcagctgatgtacttccacagaagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggataaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5553 - RNA, 9879 nt, synthetic construct
  misc_feature 1..9879: note = derived and/or modified CDS sequence (wt) from DENV-1__KJ189360__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgtattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcattatcgacggcccagacaccccagaatgtcctgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaaaacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcaccttcaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacacccttcggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtacgcagatgatacagccggatgggacacaagagtaacagaggatgacctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcacgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcgatgaagagattcaagaatgagagtgattccgaaggagcactctggtaa

SEQ ID NO: 5554 - RNA, 9879 nt, synthetic construct
  misc_feature 1..9879: note = derived and/or modified CDS sequence (wt) from DENV-1__KJ189361__SS-prME
  source 1..9879: mol_type = other RNA
tccgtgaccatgctcctcatgctgctgcccacagccatggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaataccaccttcattatcgacggcccagacaccccagaatgtcctgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaaaacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattccttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttctcataacagaaaacaaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcaccttcaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagtatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagagaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagttcaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgtactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgacctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgctcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctgggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5555 - RNA, 9879 nt, synthetic construct
  misc_feature 1..9879: note = derived and/or modified CDS sequence (wt) from DENV-1__KJ189362__SS-prME
  source 1..9879: mol_type = other RNA
tccgtgaccatgctcctcatgctgcttcccacagccctggcgtttcatttgaccacacgagggggagagccacacatgatagttagtaagcaggagagaggaaagtcactcttgtttaagacctctgcgggcgtcaatatgtgcaccctcattgcgatggacttgggagagttatgtgaggacacaatgacctacaaatgcccccggatcactgaggcagaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgtgtcaccaccatggcaaaaaataaaccaacattggacattgaactcttgaagacagaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggggccctcacattggactgctcacctagaacagggctggactttaacgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggaatgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactctccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaatcttggcccaaggaaaaaaaatgattaggccacaacccatggaacacaaatactcatggaaaagctggggaaaagctaaaatcataggagcagacatacaaaacaccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgtacctggccgaaatctcacactctatggagcaatggagttttggaaagtgaaatgataatcccaaagatatatggaggaccaatatctcagcacaactacagaccagggtatttcacacaaacagcagggccatggcacctgggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacgggtgttggtatggcatggaaatcagaccagtgaaggagaaggaggagaatctagttaggtcaatggtctctgcaggatcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttgtggaccaccttattgtctctgacatttgtcagaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggtagctcagccgatttatcattggagaaagcggctgaagtgtcctgggaacaagaagcagaacattccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagcttatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatactggaaatagggaaacttccacaacatttgacgctaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgtactgttatggatggccagtgtggagccccattggatagcggcctccatcatactagagttctttttgatggtgctgctcattccagagccagacagacagcgcactccacaggacaaccagctagcatatgtggtgataggcttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacatacaattgaaaatacaacggcaaacatttccctaaccgccattgcaaatcaggcagctatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaagaacctatcccaatggcgacctatggatggaacctagtaaaactacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcttaaatccttacatgccaagtgtggtagaaactctagagcgaatgcaaagaaaacatggagggatgctagtgcgaaacccactctcaagaaattctacccatgaaatgtattgggtttcatgtggaacgggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagacatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgtacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaagattttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagacgatacagccggatgggacacaagagtaacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggtgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagctataaaccaagtgagaaggctcatcgggaatgagaattatttagattacatgacatcaatgaagagattcaagaatgagagtgattccgaaggagcactctggtaa

SEQ ID NO: 5556 - RNA, 9879 nt, synthetic construct
  misc_feature 1..9879: note = derived and/or modified CDS sequence (wt) from DENV-1__KJ189363__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggattactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcatggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaagggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacattgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaggtccacacttggacagagcaatacaaattccaggctgactccccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaataccaccttcattattgacggcccagacaccccagaatgtcctgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaaaacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattccttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcaccttcaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggttacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaagaaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcattactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaacataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagtttgaagcccttggttttatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgacctccagaatgaggctaaaatcactgatatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5557 - RNA, 9879 nt, synthetic construct
  misc_feature 1..9879: note = derived and/or modified CDS sequence (wt) from DENV-1__KJ189364__SS-prME
  source 1..9879: mol_type = other RNA
tccgtgaccatgctcctcatgctgcttcccacagccctggcgtttcatttgaccacacgagggggagagccacacatgatagttagtaagcaggagagaggaaagtcactcttgtttaagacctctgcgggcgtcaatatgtgcaccctcattgcgatggacttgggagagttatgtgaggacacaatgacctacaaatgcccccggatcactgaggcagaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgtgtcaccaccatggcaaaaaataaaccaacattggacattgaactcttgaagacagaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggggccctcacattggactgctcacctagaacagggctggactttaacgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggaatgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgttcagcggtgtctcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactctccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaatcttggcccaaggaaaaaaaatgattaggccacaacccatggaacacaaatactcatggaaaagctggggaaaagctaaaatcataggagcagacatacaaaacaccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgtacctggccgaaatctcacactctatggagcaatggagttttggaaagtgaaatgataatcccaaagatatatggaggaccaatatctcagcacaactacagaccagggtatttcacacaaacagcagggccatggcacctgggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgcttcagaggagaagacgggtgttggtatggcatggaaatcagaccagtgaaggagaaggaggagaatctagttaggtcaatggtctctgcaggatcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcagaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggtagctcagccgatttatcattggagaaagcggctgaagtgtcctgggaacaagaagcagaacattccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagcttatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatactggaaatagggaaacttccacaacatttgacgctaagagcccagaatgctctggacaacttggtcatgttgcacaattccgaacaaggaggaaaagcctacagacatgctatggaggaactaccagacaccatagaaacactgatgctactagctttgatagctgtgttgactggtggagtgacgctgttcttcctgtcaggaaaaggcctagggaaaacatctattggcttgctctgtgtgacggcctcaagcgcactgttatggatggccagtgtggagccccattggatagcggcttccatcatactagagttctttttgatggtgctgctcattccagagccagacagacagcgcactccacaggacaaccagctagcatatgtggtgataggcttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacatacaattgaaaatacaacggcaaacatttccctaaccgccattgcaaatcaggcagctatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaagaacctatcccaatggcgacctatggatggaacctagtaaaactacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcttaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagacatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgtacaccaagagcaaaacgaggcacaacacagattatggaggtgacagccaagtggttatggagtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaagattttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagacgatacagccggatgggacacaagagtaacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa
